(12) United States Patent
Cutler et al.

(10) Patent No.: US 10,934,559 B2
(45) Date of Patent: Mar. 2, 2021

(54) HYPERSENSITIVE ABA RECEPTORS

(71) Applicant: The Regents of the University of California, Oakland, CA (US)

(72) Inventors: Sean Cutler, Riverside, CA (US); Michael Nuccio, Research Triangle Park, NC (US); Quideng Que, Research Triangle Park, NC (US)

(73) Assignee: The Regents of the University of California, Oakland, CA (US)

( * ) Notice: Subject to any disclaimer, the term of this patent is extended or adjusted under 35 U.S.C. 154(b) by 40 days.

(21) Appl. No.: 15/994,394

(22) Filed: May 31, 2018

(65) Prior Publication Data

US 2018/0265886 A1 Sep. 20, 2018

Related U.S. Application Data

(60) Division of application No. 14/960,287, filed on Dec. 4, 2015, now abandoned, which is a continuation-in-part of application No. PCT/US2015/047020, filed on Aug. 26, 2015.

(60) Provisional application No. 62/042,095, filed on Aug. 26, 2014, provisional application No. 62/098,025, filed on Dec. 30, 2014.

(51) Int. Cl.
| | |
|---|---|
| *A01H 5/00* | (2018.01) |
| *C12N 15/00* | (2006.01) |
| *C12N 15/82* | (2006.01) |
| *C07K 14/415* | (2006.01) |

(52) U.S. Cl.
CPC .......... *C12N 15/8271* (2013.01); *A01H 5/00* (2013.01); *C07K 14/415* (2013.01); *C12N 15/00* (2013.01); *C12N 15/8213* (2013.01); *C12N 15/8243* (2013.01); *C12N 15/8273* (2013.01); *C12N 15/8293* (2013.01)

(58) Field of Classification Search
None
See application file for complete search history.

(56) References Cited

U.S. PATENT DOCUMENTS

| | | |
|---|---|---|
| 2011/0271408 A1 | 11/2011 | Cutler et al. |
| 2016/0194653 A1 | 7/2016 | Cutler et al. |

FOREIGN PATENT DOCUMENTS

| | | |
|---|---|---|
| WO | 2013006263 A2 | 1/2013 |
| WO | 2016033230 | 3/2016 |

OTHER PUBLICATIONS

Finn, et al., "Pfam: The Protein Families Database", Nucleic Acids Research, vol. 42, Jan. 1, 2014, pp. D222-D230.
Klingler, et al., "ABA Receptors: The START of a New Paradigm in Phytohormone Signalling", Journal of Experimental Botany, vol. 61, No. 12, May 10, 2010, pp. 3199-3210.
Melcher, et al., "A Gate-Latch-Lock Mechanism for Hormone Signaling by Abscisic Acid Receptors", Nature, vol. 462, No. 7273, Nov. 6, 2009, pp. 602-610.
Melcher, et al., "Identification and Mechanism of ABA Receptor Antagonism", Nature Structural Biology, Nature Publishing Group, New York, US, vol. 17, No. 9, Sep. 1, 2010, pp. 1102-1108.
Nakagawa, et al., "Mechanism of High-Affinity Abscisic Acid Binding to PVL9/RCAR1", Genes to Cells, vol. 19 No. 5, May 2014, pp. 386-404.
PCT/US2015/047020, "International Search Report and Written Opinion", dated Jan. 19, 2016, 21 pages.
Sander, et al., "CRISPR-Cas Systems for Editing, Regulating and Targeting Genomes", Nature Biotechnology, vol. 32, No. 4, Mar. 2, 2014, pp. 347-355.
Santiago, et al., "The Abscisic Acid Receptor PYR1 in Complex With Abscisic Acid", Nature, vol. 462, No. 7273, Dec. 3, 2009, pp. 665-668.
Wang et al., "Interaction Between Abscisic Acid Receptor PYL3 and Protein Phosphatase Type 2C in Response to ABA Signaling in Maize," Gene, Elsevier, Amsterdam, NL, vol. 549, No. 1, Aug. 1, 2014, 179-185.

*Primary Examiner* — Phuong T Bui
(74) *Attorney, Agent, or Firm* — Kilpatrick Townsend & Stockton LLP

(57) ABSTRACT

Hypersensitive PYR/PYL polypeptides, compositions, and methods are provided.

9 Claims, 15 Drawing Sheets

Specification includes a Sequence Listing.

FIG. 2

| | | | | | |
|---|---|---|---|---|---|
| PYR1 | F$_{61}$ | V$_{81}$ | I$_{110}$ | E$_{141}$ | A$_{160}$ |
| PYL1 | F$_{88}$ | V$_{108}$ | I$_{137}$ | E$_{171}$ | A$_{190}$ |
| PYL2 | F$_{66}$ | V$_{86}$ | I$_{114}$ | E$_{147}$ | A$_{166}$ |
| PYL3 | F$_{81}$ | V$_{101}$ | V$_{134}$ | E$_{170}$ | V$_{189}$ |
| PYL4 | F$_{85}$ | V$_{105}$ | V$_{138}$ | E$_{168}$ | V$_{187}$ |
| PYL5 | F$_{82}$ | V$_{102}$ | V$_{134}$ | E$_{165}$ | V$_{184}$ |
| PYL6 | F$_{65}$ | V$_{87}$ | I$_{110}$ | E$_{142}$ | A$_{161}$ |
| PYL7 | F$_{65}$ | V$_{85}$ | I$_{115}$ | E$_{153}$ | V$_{180}$ |
| PYL8 | F$_{58}$ | V$_{77}$ | V$_{109}$ | E$_{145}$ | V$_{163}$ |
| PYL9 | F$_{44}$ | V$_{60}$ | V$_{92}$ | E$_{128}$ | A$_{138}$ |
| PYL10 | F$_{46}$ | V$_{66}$ | I$_{98}$ | E$_{133}$ | A$_{137}$ |
| PYL11 | F$_{49}$ | V$_{65}$ | I$_{95}$ | E$_{125}$ | V$_{144}$ |
| PYL12 | F$_{49}$ | V$_{65}$ | I$_{95}$ | E$_{125}$ | V$_{144}$ |
| PYL13 | F$_{101}$ | L$_{121}$ | V$_{150}$ | E$_{183}$ | V$_{202}$ |
| ZmPYLc | F$_{80}$ | L$_{100}$ | I$_{129}$ | E$_{160}$ | V$_{179}$ |
| ZmPYLi | F$_{82}$ | V$_{102}$ | V$_{131}$ | E$_{162}$ | V$_{181}$ |
| ZmPYLa | F$_{101}$ | V$_{120}$ | V$_{149}$ | E$_{180}$ | V$_{199}$ |
| ZmPYLb | F$_{97}$ | V$_{116}$ | V$_{145}$ | E$_{176}$ | V$_{195}$ |
| ZmPYLo | F$_{74}$ | V$_{98}$ | I$_{127}$ | E$_{157}$ | A$_{176}$ |
| ZmPYLj | F$_{74}$ | V$_{98}$ | I$_{127}$ | E$_{157}$ | A$_{176}$ |
| ZmPYLk | F$_{70}$ | V$_{90}$ | V$_{119}$ | E$_{148}$ | T$_{167}$ |
| ZmPYLj | F$_{91}$ | V$_{109}$ | F$_{138}$ | E$_{169}$ | V$_{188}$ |
| ZmPYLd | F$_{86}$ | V$_{104}$ | F$_{133}$ | E$_{164}$ | V$_{183}$ |
| ZmPYLf | F$_{70}$ | V$_{89}$ | F$_{118}$ | E$_{149}$ | V$_{168}$ |
| ZmPYLe | F$_{70}$ | V$_{89}$ | F$_{118}$ | E$_{149}$ | V$_{168}$ |
| ZmPYLg | | | | | |

FIG. 3

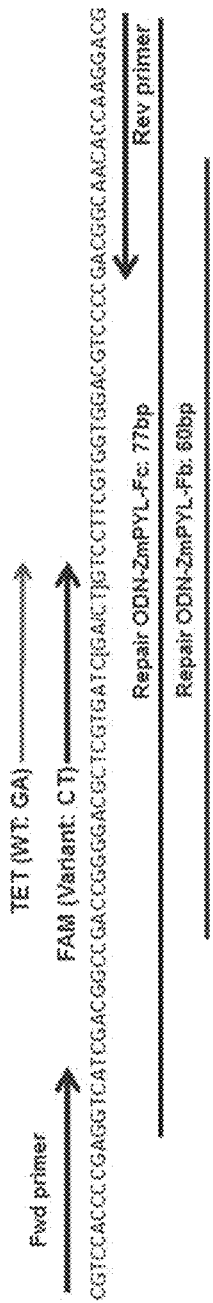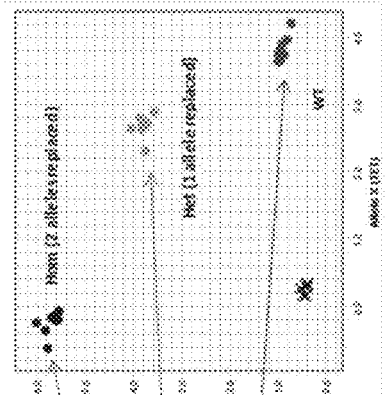
FIG. 12

Figure 13 DNA sequence analysis of ZmPYL-F gene in targeted mutant lines

```
ZmPYL-F        G  I  L  V        I  E164S  Y  V  V  D
WT   5'- GACGGCCGACCGGGGAGCGCTCGTGATCGAGTCCTTCG/TGGTGGACGTCCCCGACGG -3'
1a   5'- GACGGCCGACCGGGGAGCGCTCGTGATCGAGTCGAGTCCTTCGATGGTGGACGTCCCCGACGG -3'
1b   5'- ------------------------------------------------CCCCGACGG -3'
2a   5'- GACGGCCGACCGGGGACGCTCGTGATCGAGTCCTT--GGTGGACGTCCCCGACGG -3'
2b   5'- GACGGCCGACCGGGGACGCTCGTGATCGAGTCGAG---------CCCGACGG -3'
3a   5'- GACGGCCGACCGGGGACGCTCGTGATCGAGTCCTTC-TGGTGGACGTCCCCGACGG -3'
3b   5'- GACGGCCGACCGGGGACGCTCGTGATCGAGTCGAGTCCTTCGGTGGACGTCCCCGACGG -3'
4a   5'- GACGGCCGACCGGGGACGCTCGTGATCGAGTCCTTCG-GGTGGACGTCCCCGACGG -3'
4b   5'- GACGGCCGACCGGGGACGCTCGTCGTGATCGAGTCGAGTCCTTCGGTGGACGTCCCCGACGG -3'
5    5'- GACGGCCGACCGGGGACGCTCGTGATCGAGTCGAGTCC---(+16bps)-GTCCCCGACGG -3'
6    5'- ------------------------------------------------CCCGACGG -3'
7a   5'- GACGGCCGACCGGGGACGCTCGTGATCGAGTCGAGTCCTTCGAGT-------GGTGGACGTCCCCGACGG -3'
7b   5'- GACGGCCGACCGGGGACGCTCGTCGTGATCGAGTCGAGTCCTTCG-GGTGGACGTCCCCGACGG -3'
8a   5'- GACGGCCGACCGGGGACGCTCGTGATCGAGTCGAGTCCTTCGTTGGTGGACGTCCCCGACGG -3'
8b   5'- GACGGCCGACCGGGGACGCTCGTGATCGAGTCGAGT------GGACGTCCCCGACGG -3'
9a   5'- GACGGCCGACCGGGGACGCTCGTGATCGAGTCCTTCG-----ACGTCCCCGACGGC -3'
9b   5'- GACGGCCGACCGGGGAC-----------------------GTCCCCGACGGC -3'
```

Line 1: MZDT150600A033A
Line 2: MZDT150600A062A
Line 3: MZDT150600A065A
Line 4: MZDT150600A069A
Line 5: MZET150707A002A (16 bps = TCAAGTGCAACCTCAA)
Line 6: MZET150707A005A
Line 7: MZET150707A006A
Line 8: MZET150707A008A
Line 9: MZET150707A064A

HYPERSENSITIVE ABA RECEPTORS

CROSS-REFERENCE TO RELATED PATENT APPLICATIONS

The present patent application is a divisional of U.S. patent application Ser. No. 14/960,287, filed Dec. 4, 2015 (abandoned), which is a continuation-in-part of PCT/US2015/047020, filed Aug. 26, 2015, which claims benefit of priority to U.S. Provisional Patent Application No. 62/042,095, filed Aug. 26, 2014 and U.S. Provisional Patent Application No. 62/098,025, filed Dec. 30, 2014, which are incorporated by reference for all purposes.

STATEMENT AS TO RIGHTS TO INVENTIONS MADE UNDER FEDERALLY SPONSORED RESEARCH AND DEVELOPMENT

This invention was made with Government support under Grant No. 1258175 awarded by the National Science Foundation. The Government has certain rights in this invention.

SEQUENCE LISTING

The instant application contains a Sequence Listing which has been filed electronically in ASCII format and is hereby incorporated by reference in its entirety. Said ASCII copy, created on Apr. 14, 2020, is named 081906-1088832-217621US_SL.txt and is 695,452 bytes in size.

BACKGROUND OF THE INVENTION

Abscisic acid (ABA) is a plant hormone that regulates signal transduction associated with abiotic stress responses Cutler, S. R., et al. Annu. Rev. Plant Biol. 61, 651-679 (2010)). The ABA signaling pathway has been exploited to improve plant stress response and associated yield traits via numerous approaches (Wang, Y., et al. Plant J. 43, 413-424 (2005)). The direct application of ABA to plants improves their water use efficiency (Rademacher, W., Maisch, R., Liessegang, J., & Jung, J. (1987). Water consumption and yield formation in crop plants under the influence of synthetic analogues of abscisic acid. Plant growth regulators for agricultural and amenity use. BCPC Monograph, (36), 53-66); for this reason, the discovery of ABA agonists (Okamoto, M., et al., Proc. Natl. Acad. Sci. U.S.A. 110, 12132-12137 (2013); Park, S.-Y., et al. Science 324, 1068-1071 (2009)) has received increasing attention, as such molecules may be beneficial for improving crop yield. A complementary approach to activating the ABA pathway involves increasing a plant's sensitivity to ABA via genetic methods. For example, conditional antisense of farnesyl transferase beta subunit gene, which increases a plant's ABA sensitivity, improves yield under moderate drought in both canola and Arabidopsis (Wang et al., 2005).

It has recently been discovered that ABA elicits many of its cellular responses by binding to a soluble family of receptors called PYR/PYL proteins. PYR/PYL proteins belong to a large family of ligand-binding proteins named the START superfamily (Iyer, L. M., et al., Proteins Struct. Funct. Bioinforma. 43, 134-144, 2001; Ponting, C. P., and Aravind, L. (1999). Trends Biochem. Sci. 24, 130-132 1999). These proteins contain a conserved three-dimensional architecture consisting of seven anti-parallel beta sheets, which surround a central alpha helix to form a "helix-grip" motif; together, these structural elements form a ligand-binding pocket for binding ABA or other agonists.

Structural and functional studies have uncovered a series of conformational changes and critical contacts between PYR/PYL receptors and type II C protein phosphatases (PP2Cs) that are necessary for ABA-mediated PP2C inhibition by receptors. For example, when ABA or another agonist binds within the ligand-binding pockets of PYR/PYL proteins, it stabilizes a conformational change that allows the receptors to bind and inhibit a family of PP2Cs that normally repress ABA signaling (Weiner et al., 2010). In particular, ABA binding leads to a large rearrangement in a flexible "gate" loop that flanks the ligand-binding pocket. Upon ABA binding, the gate loop adopts a closed conformation that is stabilized by several direct contacts between the loop and ABA. This agonist-bound, closed form of the gate allows PYR/PYL proteins to dock into, and inhibit, the active site of PP2Cs. The resulting inhibition in turn allows activation of downstream kinases in the SnRK2 class, which are responsible for the regulation of the activity of transcription factors, ion channels and other proteins involved in ABA responses (Weiner, J. J., et al. (2010) Curr. Opin. Plant Biol. 13, 495-5022010). Thus, the stabilization of a closed gate conformation of the receptors plays a role in their activation and PYR/PYL receptors are molecular switches at the apex of a signaling cascade that regulates diverse ABA responses.

In addition to the role that gate closure plays in receptor activation, other structural rearrangements also occur. For example, PYR1, PYL1, and PYL2 are homodimers in solution, but bind to PP2Cs as monomers. The homodimer interface overlaps with the PP2C binding interface and therefore an intact receptor homodimer cannot bind to and inhibit the PP2C. Thus, dimer formation is antagonistic to ABA signaling and receptor dimer-breaking is a necessary step in receptor activation. Additionally, a recognition module containing a central conserved tryptophan "lock" residue located on the PP2C inserts into a small pore formed in the ABA-bound receptors. Mutation of the tryptophan lock residue abolishes receptor-mediated inactivation of PP2C activity, demonstrating a role of the lock residue's insertion into the receptor's pore.

Over-expression of wild type or mutant ABA receptors in transgenic Arabidopsis thaliana, Solanum lycopersicum and Oryza sativa improves drought tolerance (Gonzalez-Guzman, M., et al. (2014). J. Exp. Bot. eru219, 2014; Kim et al., J. Exp. Bot. 63, 1013-1024 2012; Santiago et al., Plant J. 60, 575-588 (2009)). ABA receptors with increased sensitivity relative to their wild type counterparts can elicit greater ABA responses when expressed in planta. Consistent with this, Pizzio et al., Plant Physiol. 163, 441-455 (2013) described the PYL4 mutation A194T mutant, which requires lower concentrations of ABA to elicit measured ABA responses in comparison to wild type PYL4. When this mutant is over-expressed in transgenic Arabidopsis, the plants have increased sensitivity to ABA relative to both wild type controls and PYL4 over-expression controls (Pizzio et al., Plant Physiol. 163, 441-455 (2013)). Moreover, the 35S::PYL4$^{A194T}$ lines display better drought tolerance and water use than wild type or 35S::PYL4 overexpression lines. The A194T mutation is located in PYL4's carboxyl terminus, which is a part of the receptors that is highly variable in length and composition between receptors. This lack of conservation makes it difficult to predict the mechanism by which the mutation alters ABA sensitivity.

BRIEF SUMMARY OF THE INVENTION

Mutations in PYR/PYL receptor proteins have been identified that result in the receptor proteins being hypersensitive to ABA. In some embodiments, nucleic acids (e.g., isolated) encoding such proteins are provided. In some embodiments, the nucleic acids comprises a polynucleotide encoding a mutated PYR/PYL receptor polypeptide comprising an amino acid substitution corresponding to the amino acid F61, V81, I110, E141, and A160 in PYR1 as set forth in SEQ ID NO:1, wherein the mutated PYR/PYL receptor has increased sensitivity to abscisic acid compared to a control PYR/PYL receptor lacking the substitution.

In some embodiments, the PYR/PYL receptor polypeptide comprises an amino acid substitution corresponding to the amino acid F61. In some embodiments, the amino acid substitution is selected from L and M.

In some embodiments, the PYR/PYL receptor polypeptide comprises an amino acid substitution corresponding to the amino acid V81. In some embodiments, the amino acid substitution is selected from I and Y.

In some embodiments, the PYR/PYL receptor polypeptide comprises an amino acid substitution corresponding to the amino acid I110. In some embodiments, the amino acid substitution is selected from C and S.

In some embodiments, the PYR/PYL receptor polypeptide comprises an amino acid substitution corresponding to the amino acid E141. In some embodiments, the amino acid substitution is selected from C, I, L, M, N, T, V, W, and Y.

In some embodiments, the PYR/PYL receptor polypeptide comprises an amino acid substitution corresponding to the amino acid A160. In some embodiments, the amino acid substitution is selected from C, I, and V.

In some embodiments, the PYR/PYL receptor polypeptide comprises an amino acid substitution corresponding to:
F61L and A160C;
F61M and A160V;
F61M, I110S, and A160V; or
F61L, V81I, I110C and A160V.

In some embodiments, the mutated PYR/PYL receptor polypeptide is substantially identical to (e.g., at least 50%, 55%, 60%, 65%, 70%, 75%, 80%, 85%, 90%, 91%, 92%, 93%, 94% 95%, 96%, 97%, 98%, or 99% identical to) any of SEQ ID NOs:1-119 or SEQ ID NOs:124-154 (e.g., 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, or 154), 155-361 (e.g., 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, or 361) or comprises any of SEQ ID NOs: 120-123.

Also provided is a plant (e.g. a transgenic or non-transgenic plant) comprising a polynucleotide encoding a PYR/PYL receptor polypeptide as described above or elsewhere herein, e.g., comprising an amino acid substitution corresponding to the amino acid F61, V81, I110, E141, and A160 in PYR1 as set forth in SEQ ID NO:1. In some embodiments, the plant will have increased sensitivity to ABA compared to a control plant lacking the polypeptide. In some embodiments, the polynucleotide is operably linked to a heterologous promoter. In some embodiments, the polynucleotide is operably linked to a native (non-heterologous) promoter. In some embodiments, the PYR/PYL receptor polypeptide comprises an amino acid substitution corresponding to: F61L and A160C; F61M and A160V; F61M, I110S, and A160V; or F61L, V81I, I110C and A160V. In some embodiments, the encoded PYR/PYL receptor polypeptide only has one (or in some embodiments, only 2, 3, or 4) amino acid substitution compared to the plant's native PYR/PYL receptor polypeptide. In some embodiments, the plant's native PYR/PYL receptor polypeptide coding sequence has been modified (e.g., by CRISPR) to contain the 1, 2, 3, or 4 substitutions. In some embodiments, the PYR/PYL receptor polypeptide comprises an amino acid substitution corresponding to the amino acid F61. In some embodiments, the amino acid substitution is selected from L and M. In some embodiments, the PYR/PYL receptor polypeptide comprises an amino acid substitution corresponding to the amino acid V81. In some embodiments, the amino acid substitution is selected from I and Y. In some embodiments, the PYR/PYL receptor polypeptide comprises an amino acid substitution corresponding to the amino acid I110. In some embodiments, the amino acid substitution is selected from C and S. In some embodiments, the PYR/PYL receptor polypeptide comprises an amino acid substitution corresponding to the amino acid E141. In some embodiments, the amino acid substitution is selected from C, I, L, M, N, T, V, W, and Y. In some embodiments, the PYR/PYL receptor polypeptide comprises an amino acid substitution corresponding to the amino acid A160. In some embodiments, the amino acid substitution is selected from C, I, and V. In some embodiments, the PYR/PYL receptor polypeptide comprises an amino acid substitution corresponding to: F61L and A160C; F61M and A160V; F61M, I110S, and A160V; or F61L, V81I, I110C and A160V.

Also provided is a plant (e.g., including but not limited to a maize plant) comprising an in situ mutated PYR/PYL receptor polypeptide comprising an amino acid substitution corresponding to the amino acid F61, V81, I110, E141, and A160 in PYR1 as set forth in SEQ ID NO:1, wherein the mutated PYR/PYL receptor polypeptide has increased sensitivity to abscisic acid compared to a control PYR/PYL receptor lacking the substitution. In some embodiments, the PYR/PYL receptor polypeptide comprises an amino acid substitution corresponding to the amino acid F61. In some embodiments, the amino acid substitution is selected from L and M. In some embodiments, the PYR/PYL receptor polypeptide comprises an amino acid substitution corresponding to the amino acid V81. In some embodiments, the amino acid substitution is selected from I and Y. In some embodiments, the PYR/PYL receptor polypeptide comprises an amino acid substitution corresponding to the amino acid I110. In some embodiments, the amino acid substitution is selected from C and S. In some embodiments, the PYR/PYL receptor polypeptide comprises an amino acid substitution corresponding to the amino acid E141. In some embodiments, the amino acid substitution is selected from C, I, L, M, N, T, V, W, and Y. In some embodiments, the PYR/PYL receptor polypeptide comprises an amino acid substitution corresponding to the amino acid A160. In some embodiments, the amino acid substitution is selected from C, I, and V. In some embodiments, the PYR/PYL receptor polypeptide comprises an amino acid substitution corresponding to: F61L and A160C; F61M and A160V; F61M, I110S, and A160V; or F61L, V81I, I110C and A160V. In some embodiments, the mutated PYR/PYL receptor polypeptide is substantially identical to (e.g., at least 50%, 55%, 60%, 65%, 70%, 75%, 80%, 85%, 90%, 91%, 92%, 93%, 94% 95%, 96%, 97%, 98%, or 99% identical to) any of SEQ ID NOs:1-119 or SEQ ID NOs:124-154 (e.g., 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, or 154), 155-361 (e.g., 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, or 361) or comprises any of SEQ ID NOs: 120-123.

Also provided are expression cassettes comprising a promoter operably linked to the polynucleotide encoding a PYR/PYL receptor polypeptide as described above or elsewhere herein, e.g., comprising an amino acid substitution corresponding to the amino acid F61, V81, I110, E141, and A160 in PYR1 as set forth in SEQ ID NO:1, wherein introduction of the expression cassette into a plant results in the plant having increased sensitivity to abscisic acid compared to a control plant lacking the expression cassette.

In some embodiments, the promoter is heterologous to the polynucleotide. In some embodiments, the promoter is inducible. In some embodiments, the promoter is a stress-inducible promoter.

Also provided is an expression vector comprising the expression cassette as described above or elsewhere herein.

Also provided are plants comprising an expression cassette as described above or elsewhere herein, wherein the plant has increased sensitivity to abscisic acid compared to a control plant lacking the expression cassette. Also provided is a plant cell from the plant.

Also provided is a seed, flower, leaf, fruit, processed food, or food ingredient from a plant comprising a hypersensitive a PYR/PYL receptor polypeptide as described herein.

Also provided is a method of producing a plant having increased sensitivity to abscisic acid. In some embodiments, the method comprises: introducing the expression cassette encoding a hypersensitive a PYR/PYL receptor polypeptide as described herein into a plurality of plants; and selecting a plant that expresses the polynucleotide from the plurality of plants.

In some embodiments, the method comprises: introducing a mutation into a polynucleotide encoding a hypersensitive PYR/PYL polypeptide as described herein, e.g., wherein the mutation results in a polynucleotide encoding an amino acid substitution corresponding to the amino acid F61, V81, 1110, E141, and A160 in PYR1 as set forth in SEQ ID NO:1. In some embodiments, the introducing occurs in situ in the genome of a plant cell. In some embodiments, the introducing comprises clustered regularly interspaced short palindromic repeats (CRISPR)/Cas genome editing.

Provided herein are methods and reagents for producing a plant (e.g., a maize plant) having increased sensitivity to abscisic acid, the method includes introducing a mutation into a polynucleotide encoding a PYR/PYL polypeptide, where the mutation is introduced in situ in the genome of the plant using RNA directed genome modification methods.

In one aspect, provided herein is a guide ribonucleic acid (gRNA). In certain embodiments the gRNA includes a CRISPR ribonucleic acid (crRNA) that is substantially identical to SEQ ID NOS: 363, 364, 365, 366, 367 or 369; and a transacting ribonucleic acid (tracRNA), where the PYR/PYL mutation target site comprises a nucleic acid that encodes for V89 of PYL-E or E149 of PYL-E.

In some embodiments of the gRNA, the PYR/PYL mutation target site includes a nucleic acid that encodes for V89 of PYL-E. In some embodiments, the PYR/PYL mutation target site has the sequence of SEQ ID NO:362.

In some embodiments, the PYR/PYL mutation target site includes a nucleic acid that encodes for E149 of PYL-E. In certain embodiments, the PYR/PYL mutation target site has the sequence of SEQ ID NO:368.

In certain embodiments, the tracRNA is linked to the 3' end of the gRNA. In specific embodiments, the tracRNA is encoded by a nucleotide having a sequence that is substantially identical to SEQ ID NO: 370.

In another aspect, provided herein is an isolated nucleic acid that includes a polynucleotide encoding any one of the gRNAs described herein.

In another aspect, provided herein is an expression cassette that includes an RNA polymerase promoter operably linked to a polynucleotide encoding any one of the gRNAs described herein. In certain embodiments, the RNA polymerase promoter is an RNA polymerase III (polIII) promoter. In specific embodiments, the polIII promoter is a U3 promoter or a U6 promoter. In some embodiments, the expression cassette has the sequence of any one of SEQ ID NOS:371-373.

In another aspect, provided herein is an expression vector that includes an expression cassette, where the expression cassette includes an RNA polymerase promoter operably linked to a polynucleotide encoding any one of the gRNAs described herein.

In another aspect, provided herein is an expression vector that includes a first expression cassette and a second expression cassette. In certain embodiments, the first expression cassette is an expression cassette that includes an RNA polymerase promoter operably linked to a polynucleotide encoding any one of the gRNAs described herein and the second expression cassette is an expression cassette comprising a promoter operably linked to a polynucleotide encoding a CRISPR-associated endonuclease 9 (Cas9). In some embodiments, the expression vector includes a third expression cassette, wherein the third expression cassette is an expression cassette that includes an RNA polymerase promoter operably linked to a polynucleotide encoding any one of the gRNAs described herein, and the third expression cassette is different than the first expression cassette.

In some embodiments, the expression vector includes a first, second and third expression cassette, where the first expression cassette is an expression cassette that includes a promoter operably linked to a polynucleotide encoding a CRISPR-associated endonuclease 9 (Cas9), the second expression cassette has a sequence that is substantially identical to SEQ ID NO: 371 or SEQ ID NO:372, and the third expression cassette has a sequence that is substantially identical to SEQ ID NO:373. In certain embodiments, the promoter operably linked to the polynucleotide encoding Cas9 is an ubiquitin-1 promoter (prUbi-10).

In another aspect, provided herein is a cell that includes any of the expression vectors described above or elsewhere herein.

Also provided is a plant that includes an expression vector as described above or elsewhere herein. In some embodiments, the plant is a maize plant.

Also provided is a plant cell from the plant described above or elsewhere herein.

In another aspect, provided herein is a seed, flower, leaf, fruit, processed food, or food ingredient from the plant described above or elsewhere herein. In certain embodiments, the introduction of the expression vector into the plant described above or elsewhere herein results in the plant having increased sensitivity to abscisic acid compared to a control plant lacking the expression cassette.

In another aspect, provided herein is a method of producing a plant having a mutation at a genomic PYR/PYL mutation target site. In some embodiments the method includes introducing into plant cells an expression vector that includes a polynucleotide encoding a gRNA and a Cas9 as described above or elsewhere herein and at least one repair nucleic acid comprising the mutation. In certain embodiments, the mutation is introduced in the genomic PYR/PYLR mutation target site by a homologous recombination upon a Cas9 cleavage event in the genomic PYR/PYLR mutation target site. In some embodiments, the method further includes selecting plant cells having the mutation; thereby producing the plant. In some embodiments, the introducing occurs in situ in the genome of a plant cell. In some embodiments, the mutation is introduced by introducing into a plant embryo cell the expression vector and at least one repair nucleic acid, where the genome of the plant embryo comprises the PYR/PYL mutation target site and where the repair nucleic acid comprises the mutation and introduces the mutation at the PYR/PYL mutation target site by homologous recombination upon a Cas9 cleavage event in the PYL-E mutation target site.

In some embodiments, the repair nucleic acid has a sequence that is substantially identical to any one of the sequence of SEQ ID NOS:375 to 387 In certain embodiments, the repair nucleic acid has a sequence that is substantially identical to SEQ ID NO:377. In some embodiments, the repair nucleic acid has a sequence that is substantially identical to the sequence of SEQ ID NO:387. In other embodiments, two repair nucleic acids are introduced, and wherein the repair nucleic acids have sequences that are substantially identical to SEQ ID NO:377 and SEQ ID NO:379. In specific embodiments, the plant is a maize plant.

In another aspect, provided herein is a kit that includes an expression vector of that includes a polynucleotide encoding a gRNA and a polynucleotide encoding a Cas9 as described above or elsewhere herein and at least one repair nucleic acid, wherein the repair nucleic acid comprises a PYL-E mutation and is capable of introducing the PYL-E mutation in situ in a plant cell genome by homologous recombination upon a Cas9 cleavage event. In some embodiments, the at least one repair nucleic acid has a sequence that is substantially identical to SEQ ID NOS:374 to 386.

In another aspect, provided herein is an isolated nucleic acid comprising a polynucleotide encoding a mutated PYR/PYL receptor polypeptide comprising an amino acid substitution corresponding to the amino acid V89 in PYL-E, wherein the amino acid substitution is A (SEQ ID NO:389). In some embodiments, the mutated PYR/PYL receptor polypeptide further comprises an amino acid substitution corresponding to the amino acid E149. In certain embodiments the amino acid substitution corresponding to the amino acid E149 is L (SEQ ID NO:390).

In yet another aspect, provided herein is an isolated nucleic acid comprising a polynucleotide encoding a fusion protein comprising a mutated PYR/PYL receptor polypeptide and a fusion partner polypeptide, wherein the mutated PYR/PYL receptor polypeptide comprises an amino acid substitution corresponding to the amino acid V89 in PYL-E, wherein the amino acid substitution is A. In certain embodiments, the mutated PYR/PYL receptor polypeptide further comprises an amino acid substitution corresponding to the amino acid E149. In specific embodiments, the amino acid substitution corresponding to the amino acid E149 is L.

In some embodiments, the fusion partner polypeptide includes a transcription activation domain or a transcription modulation domain. In certain embodiments, the transcription activation domain is VP16 or VP64. In certain embodiments, the fusion protein further comprises a nuclear localization signal sequence. In some embodiments, the mutated PYR/PYL receptor polypeptide has increased sensitivity to abscisic acid compared to a control PYR/PYL receptor polypeptide lacking the substitution.

Provided herein is a cell comprising a polynucleotide as described above or elsewhere herein. In certain embodiments, the polynucleotide is a heterologous polypeptide. In some embodiments, the cell is a non-plant eukaryotic cell.

In yet another embodiment, provided herein is a plant that includes a polynucleotide as described above or elsewhere herein. In certain embodiments, the plant is a maize plant.

In another embodiment, provided herein is an expression cassette comprising a promoter operably linked to a polynucleotide as described above or elsewhere herein. In some embodiments, the promoter is heterologous to the polynucleotide. In certain embodiments, the promoter is inducible. In some embodiments, the promoter is a stress-inducible promoter.

In another embodiment, provided herein is an expression vector comprising the expression cassette as described above or elsewhere herein.

In another aspect, provided herein is a plant that includes the expression cassette as described above or elsewhere herein. In another aspect, provided herein is a plant cell from the plant as described above or elsewhere herein. In yet another aspect, provided herein is a seed, flower, leaf, fruit, processed food, or food ingredient from the plant as described above or elsewhere herein.

Other aspects of the invention are described elsewhere herein.

Definitions

The term "PYR/PYL receptor polypeptide" refers to a protein characterized in part by the presence of one or more or all of a polyketide cyclase domain 2 (PF10604), a polyketide cyclase domain 1 (PF03364), and a Bet V I domain (PF03364), which in wild-type form mediates abscisic acid (ABA) and ABA analog signaling. A wide variety of PYR/PYL receptor polypeptide sequences are known in the art. In some embodiments, a PYR/PYL receptor polypeptide comprises a polypeptide that is substantially identical to PYR1 (SEQ ID NO:1), PYL1 (SEQ ID NO:2), PYL2 (SEQ ID NO:3), PYL3 (SEQ ID NO:4), PYL4 (SEQ ID NO:5), PYL5 (SEQ ID NO:6), PYL6 (SEQ ID NO:7), PYL7 (SEQ ID NO:8), PYL8 (SEQ ID NO:9), PYL9 (SEQ ID NO:10), PYL10 (SEQ ID NO:11), PYL11 (SEQ ID NO:12), PYL12 (SEQ ID NO:13), or PYL13 (SEQ ID NO:14), or to any of SEQ ID NOs:15-119.

A "wild-type PYR/PYL receptor polypeptide" refers to a naturally occurring PYR/PYL receptor polypeptide that mediates abscisic acid (ABA) and ABA analog signaling.

A "mutated PYR/PYL receptor polypeptide" refers to a PYR/PYL receptor polypeptide that is a variant from a naturally-occurring (i.e., wild-type) PYR/PYL receptor polypeptide. As used herein, a mutated PYR/PYL receptor polypeptide comprises one, two, three, four, or more amino acid substitutions relative to a corresponding wild-type PYR/PYL receptor polypeptide while retaining ABA-responsiveness of the receptor. In this context, a "mutated" polypeptide can be generated by any method for generating non-wild type nucleotide sequences. In some embodiments, a mutated PYR/PYL receptor polypeptide is hypersensitive, meaning the mutant receptor polypeptide is activated by ABA more strongly than a corresponding homologous wild-type receptor (or at least compared to an otherwise identical PYR/PYL polypeptide having the wildtype amino acid at the mutated position described herein) would be activated by the same concentration of ABA, or that the mutant receptor polypeptide is activated by a lower (e.g., half or less of the) concentration of ABA than activates the corresponding homologous wildtype receptor, or both. In some embodiments, the mutant receptor polypeptide can be determined visually in a HAB1 yeast two-hybrid assay to respond to 0.25 µM or less ABA.

An "amino acid substitution" refers to replacing the naturally occurring amino acid residue in a given position (e.g., the naturally occurring amino acid residue that occurs in a wild-type PYR/PYL receptor polypeptide) with an amino acid residue other than the naturally-occurring residue. For example, the naturally occurring amino acid residue at position 60 of the wild-type PYR1 receptor polypeptide sequence (SEQ ID NO:1) is histidine (H60); accordingly, an amino acid substitution at H60 refers to replacing the naturally occurring histidine with any amino acid residue other than histidine.

An amino acid residue "corresponding to an amino acid residue [X] in [specified sequence," or an amino acid substitution "corresponding to an amino acid substitution [X] in [specified sequence]" refers to an amino acid in a polypeptide of interest that aligns with the equivalent amino acid of a specified sequence. Generally, as described herein, the amino acid corresponding to a position of a specified PYR/PYL receptor polypeptide sequence can be determined using an alignment algorithm such as BLAST. In some embodiments of the present invention, "correspondence" of amino acid positions is determined by aligning to a region of the PYR/PYL receptor polypeptide comprising SEQ ID NO:1, as discussed further herein. When a PYR/PYL receptor polypeptide sequence differs from SEQ ID NO:1 (e.g., by changes in amino acids or addition or deletion of amino acids), it may be that a particular mutation associated with hypersensitive activity of the PYR/PYL receptor will not be in the same position number as it is in SEQ ID NO:1. For example, amino acid position V85 of PYL2 (SEQ ID NO:3) aligns with amino acid position V81 of PYR1 (SEQ ID NO:1), as can be readily illustrated in an alignment of the two sequences. In this example, amino acid position 85 in SEQ ID NO:3 corresponds to position 81 in SEQ ID NO:1. Examples of corresponding positions are shown in FIG. 2

Two nucleic acid sequences or polypeptides are said to be "identical" if the sequence of nucleotides or amino acid residues, respectively, in the two sequences is the same when aligned for maximum correspondence as described below.

The terms "identical" or percent "identity," in the context of two or more nucleic acids or polypeptide sequences, refer to two or more sequences or subsequences that are the same or have a specified percentage of amino acid residues or nucleotides that are the same, when compared and aligned for maximum correspondence over a comparison window, as measured using one of the following sequence comparison algorithms or by manual alignment and visual inspection. When percentage of sequence identity is used in reference to proteins or peptides, it is recognized that residue positions that are not identical often differ by conservative amino acid substitutions, where amino acids residues are substituted for other amino acid residues with similar chemical properties (e.g., charge or hydrophobicity) and therefore do not change the functional properties of the molecule. Where sequences differ in conservative substitutions, the percent sequence identity may be adjusted upwards to correct for the conservative nature of the substitution. Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated according to, e.g., the algorithm of Meyers & Miller, *Computer Applic. Biol. Sci.* 4:11-17 (1988) e.g., as implemented in the program PC/GENE (Intelligenetics, Mountain View, Calif., USA).

The phrase "substantial identity" or "substantially identical," used in the context of two nucleic acids or polypeptides, refers to a sequence that has at least 50% sequence identity with a reference sequence. Alternatively, percent identity can be any integer from 50% to 100%. In some embodiments, a sequence is substantially identical to a reference sequence if the sequence has at least 50%, 55%, 60%, 65%, 70%, 75%, 80%, 85%, 90%, 91%, 92%, 93%, 94%, 95%, 96%, 97%, 98%, or 99% sequence identity to the reference sequence as determined using the methods described herein; preferably BLAST using standard parameters, as described below. Embodiments of the present invention provide for nucleic acids encoding polypeptides that are substantially identical to any of SEQ ID NO:1-119 or SEQ ID NOs:155-361.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window," as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection.

Algorithms that are suitable for determining percent sequence identity and sequence similarity are the BLAST and BLAST 2.0 algorithms, which are described in Altschul et al. (1990) *J. Mol. Biol.* 215: 403-410 and Altschul et al. (1977) *Nucleic Acids Res.* 25: 3389-3402, respectively. Software for performing BLAST analyses is publicly available through the National Center for Biotechnology Information (NCBI) web site. The algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits acts as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word size (W) of 28, an expectation (E) of 10, M=1, N=−2, and a comparison of both strands. For amino acid sequences, the BLASTP program uses as defaults a word size (W) of 3, an expectation (E) of 10, and the BLOSUM62 scoring matrix (see Henikoff & Henikoff, *Proc. Natl. Acad. Sci. USA* 89:10915 (1989)).

The BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.01, more preferably less than about $10^{-5}$, and most preferably less than about $10^{-20}$.

The term "promoter," as used herein, refers to a polynucleotide sequence capable of driving transcription of a coding sequence in a cell. Thus, promoters used in the polynucleotide constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) gene transcription. A "plant promoter" is a promoter capable of initiating transcription in plant cells. A "constitutive promoter" is one that is capable of initiating transcription in nearly all tissue types, whereas a "tissue-specific promoter" initiates transcription only in one or a few particular tissue types.

A polynucleotide sequence is "heterologous" to an organism or a second polynucleotide sequence if it originates from a foreign species, or, if from the same species, is modified from its original form. For example, when a promoter is said to be operably linked to a heterologous coding sequence, it means that the coding sequence is derived from one species whereas the promoter sequence is derived another, different species; or, if both are derived from the same species, the coding sequence is not naturally associated with the promoter (e.g., is a genetically engineered coding sequence, e.g., from a different gene in the same species, or an allele from a different ecotype or variety).

An "expression cassette" refers to a nucleic acid construct that, when introduced into a host cell, results in transcription and/or translation of an RNA or polypeptide, respectively. Antisense or sense constructs that are not or cannot be translated are expressly included by this definition. In the case of both expression of transgenes and suppression of endogenous genes (e.g., by antisense, or sense suppression) one of skill will recognize that the inserted polynucleotide sequence need not be identical, but may be only substantially identical to a sequence of the gene from which it was derived. As explained herein, these substantially identical variants are specifically covered by reference to a specific nucleic acid sequence.

The term "host cell" refers to any cell capable of replicating and/or transcribing and/or translating a heterologous polynucleotide. Thus, a "host cell" refers to any prokaryotic cell (including but not limited to *E. coli*) or eukaryotic cell (including but not limited to yeast cells, mammalian cells, avian cells, amphibian cells, plant cells, fish cells, and insect cells), whether located in vitro or in vivo. For example, host cells may be located in a transgenic animal or transgenic plant. prokaryotic cell (including but not limited to *E. coli*) or eukaryotic cells (including but not limited to yeast cells, mammalian cells, avian cells, amphibian cells, plant cells, fish cells, and insect cells). Host cells can be for example, transformed with the heterologous polynucleotide.

The term "plant" includes whole plants, shoot vegetative organs and/or structures (e.g., leaves, stems and tubers), roots, flowers and floral organs (e.g., bracts, sepals, petals, stamens, carpels, anthers), ovules (including egg and central cells), seed (including zygote, embryo, endosperm, and seed coat), fruit (e.g., the mature ovary), seedlings, plant tissue (e.g., vascular tissue, ground tissue, and the like), cells (e.g., guard cells, egg cells, trichomes and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, and multicellular algae. It includes plants of a variety of ploidy levels, including aneuploid, polyploid, diploid, haploid, and hemizygous.

BRIEF DESCRIPTION OF THE DRAWINGS

FIG. 2 provides the corresponding naturally-occurring amino acid at the five positions described herein for a number of different PYR/PYL proteins.

FIG. 3 provides an alignment of the middle portion a number of PYR/PYL proteins. (SEQ ID NOs:142-154)

FIG. 12 provides a schematic drawing of end point assay example to detect specific DNA sequence change (GA to CT) in ZmPYL-F that results in E164L amino acid residue mutation.

FIG. 13 shows sequence alignment (SEQ ID NOS:414-430) of targeted mutations in ZmPYL-F mediated by gRNA-Cas9 expressed from vector 22981. FIG. 13 also discloses SEQ ID NOS 432-433, respectively, in order of appearance.

DETAILED DESCRIPTION OF THE INVENTION

I. Introduction

Figure 1:
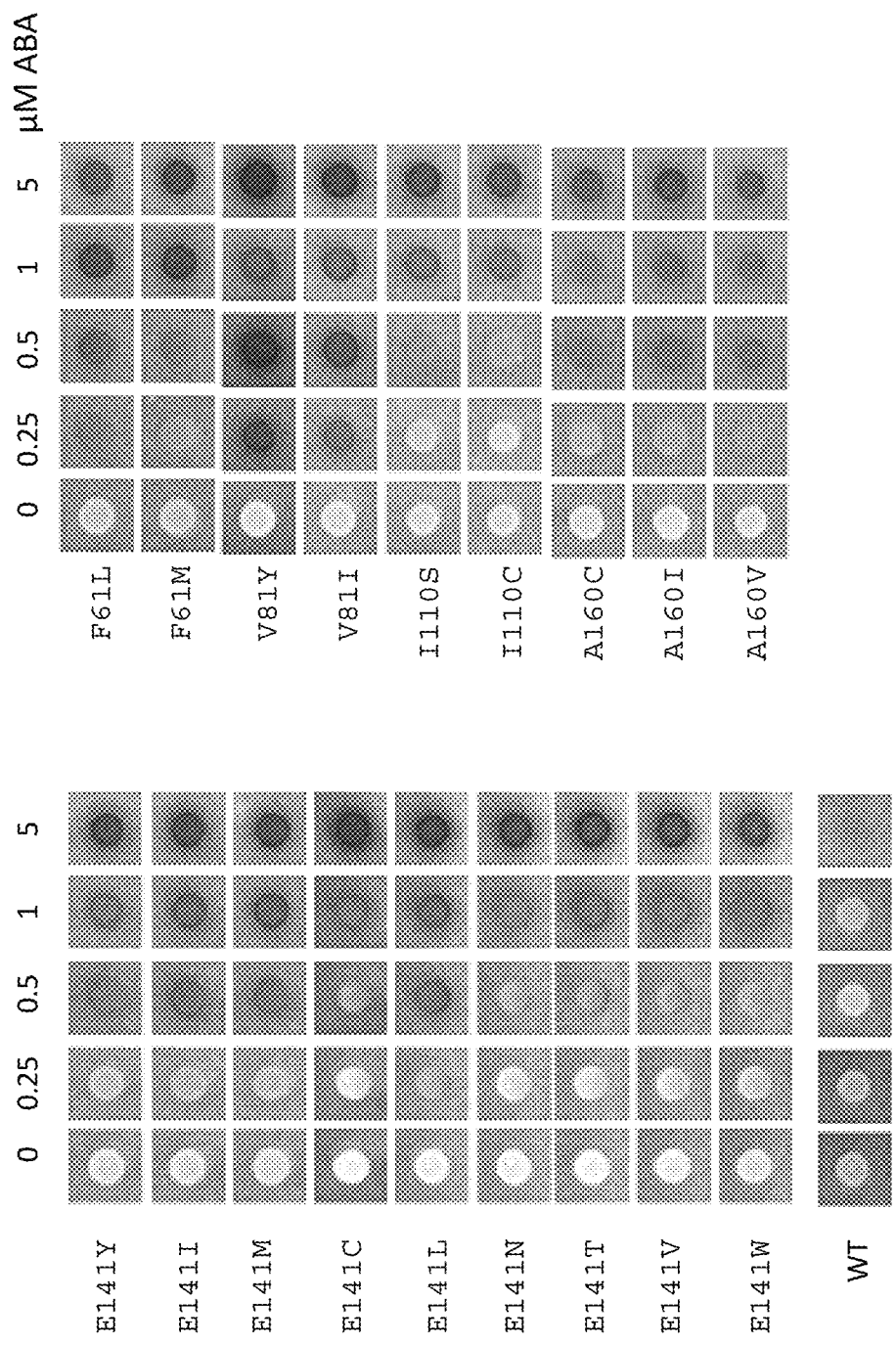
FIG. 1 provides signal in a yeast two-hybrid assay with ABA concentration shown at the top and the identity of the mutants shown on the left side.

To identify mutations causing increased receptor ABA sensitivity, we screened for mutants that lower the concentration of ABA required to induce a detectable interaction between PYR1 and HAB1 using a collection of PYR1 mutants that contain all possible single amino acid substitutions residues located in close proximity to ABA. Based on these results, we describe mutations in highly-conserved residues that substantially increase receptor ABA sensitivity.

Mutations in PYR/PYL receptor polypeptides have been discovered that result in hypersensitive forms of the PYR/PYL receptor, i.e., the mutated receptors are more responsive to the ABA compared to a corresponding wildtype PYR/PYL polypeptide.

Expression in a plant of one or more hypersensitive mutant PYR/PYl receptor polypeptides as described here will result in a plant with increased ABA-sensitivity, and in some embodiments, higher stress tolerance or other phenotypes associated with ABA-responsiveness.

Also provided herein are methods and reagents for producing a plant (e.g., a maize plant) having increased sensitivity to abscisic acid, the method includes introducing a mutation into a polynucleotide encoding a PYR/PYL polypeptide, where the mutation is introduced in situ in the genome of the plant using RNA directed genome modification methods.

II. Hypersensitive PYR/PYL Receptor Polypeptides

A wide variety of wild-type (naturally occurring) PYR/PYL polypeptide sequences are known in the art. Although PYR1 was originally identified as an abscisic acid (ABA) receptor in Arabidopsis, in fact PYR1 is a member of a group of at least 14 proteins (PYR/PYL proteins) in the same protein family in Arabidopsis that also mediate ABA signaling. This protein family is also present in other plants (see, e.g., SEQUENCE LISTING) and is characterized in part by the presence of one or more or all of a polyketide cyclase domain 2 (PF10604), a polyketide cyclase domain 1 (PF03364), and a Bet V I domain (PF03364). START/Bet v 1 superfamily domain are described in, for example, Radauer, BMC Evol. Biol. 8:286 (2008). In some embodiments, a wild-type PYR/PYL receptor polypeptide comprises any of SEQ ID NOs:1-119. In some embodiments, a wild-type PYR/PYL receptor polypeptide is substantially identical to (e.g., at least 50%, 55%, 60%, 65%, 70%, 75%, 80%, 85%, 90%, 91%, 92%, 93%, 94% 95%, 96%, 97%, 98%, or 99% identical to) any of SEQ ID NOs:1-119.

PYR/PYL receptor proteins have a conserved START-domain ligand-binding pocket flanked by two loops called the "gate" and the "latch" (Melcher, K. et al., Nature 462 (2009)). ABA binds to a PYR/PYL receptor protein at the ligand-binding pocket and ABA binding induces closure of the loops to seal ABA inside the ligand-binding pocket. The ligand-binding pocket of a PYR/PYL receptor polypeptide comprises amino acid residues that are in close proximity (e.g., within about 5 Å) to a PYR/PYL ligand (e.g., ABA) or a ligand-contacting water molecule when the ligand is bound to the PYR/PYL receptor. There are 25 residues that make up the PYR1 ligand-binding pocket. The residues of the ligand-binding pocket are also highly conserved among other PYR/PYL family members.

PYR/PYL receptor proteins directly bind to type 2 protein phosphatases (PP2Cs) and thus also contain a PP2C binding interface. The PP2C binding interface of a PYR/PYL receptor polypeptide comprises amino acid residues that are in close proximity (e.g., within about 5 Å) to PP2C when PP2C, the PYR/PYL receptor, and ABA are all bound together in a ternary complex. There are 25 residues that make up the PYR1 PP2C binding interface. The residues of the PP2C binding interface are also highly conserved among other PYR/PYL family members.

Hypersensitive PYR/PYL receptor polypeptides are non-naturally-occurring variants from naturally occurring (i.e., wild-type) PYR/PYL receptor polypeptides, wherein the variant (mutant) PYR/PYL receptor polypeptide is able to bind to and/or inhibit the activity of a PP2C in the presence of abscisic acid to a greater extent than a control PYR/PYL receptor polypeptide in the presence of the same concentration of ABA. Hypersensitive active PYR/PYL receptor polypeptides as described herein comprise one or more amino acid substitutions compared to a wild type PYR/PYL receptor polypeptide. In some embodiments, a hypersensitive PYR/PYL receptor polypeptide is substantially identical to (e.g., at least 50%, 55%, 60%, 65%, 70%, 75%, 80%, 85%, 90%, 91%, 92%, 93%, 94% 95%, 96%, 97%, 98%, or 99% identical to) any of SEQ ID NO:1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, or 119 and comprises 1, 2, 3, 4, or more mutations (e.g., amino acid substitutions) as described herein. In some embodiments, a hypersensitive PYR/PYL receptor polypeptide comprises SEQ ID NO:120, 121, 122, or 123 and comprises 1, 2, 3, 4, or more mutations (e.g., amino acid substitutions) as described herein:

```
                                              (SEQ ID NO: 120)
CxSxxxxxxxAPxxxxWxxxxxxFxxPxxxxxFxxxC (SEQ ID NO: 121)
GxxRxVxxxSxxPAxxSxExLxxxD (SEQ ID NO: 122)
GGxHRLxNYxS (SEQ ID NO: 123)
ESxxVDxPxGxxxxxTxxFxxxxxxxNLxxL.
```

As shown in the Examples, it has been discovered that mutations can be made at any of several positions in PYR/PYL receptor polypeptides result in hypersensitivity to ABA. These positions are (corresponding to their position in *Arabidopsis* PYR1 (SEQ ID NO:1)): F61, V81, I110, E141, and A160. In some embodiments, a mutated PYR/PYL receptor polypeptide comprises one or more (e.g., one, two, three, or four) amino acid substitutions corresponding to these positions. For example, in some embodiments, the mutated PYR/PYL receptor polypeptide comprises at least the following corresponding mutations:
F61L and A160C;
F61M and A160V;
F61M, I110S, and A160V; or
F61L, V81I, I110C and A160V.

```
SEQ ID NO: 1; Arabidopsis wildtype PYR1
Met Pro Ser Glu Leu Thr Pro Glu Glu Arg Ser Glu Leu Lys Asn Ser
1               5                   10                  15

Ile Ala Glu Phe His Thr Tyr Gln Leu Asp Pro Gly Ser Cys Ser Ser
            20                  25                  30

Leu His Ala Gln Arg Ile His Ala Pro Pro Glu Leu Val Trp Ser Ile
        35                  40                  45

Val Arg Arg Phe Asp Lys Pro Gln Thr Tyr Lys His Phe Ile Lys Ser
    50                  55                  60

Cys Ser Val Glu Gln Asn Phe Glu Met Arg Val Gly Cys Thr Arg Asp
65                  70                  75                  80

Val Ile Val Ile Ser Gly Leu Pro Ala Asn Thr Ser Thr Glu Arg Leu
                85                  90                  95

Asp Ile Leu Asp Asp Glu Arg Arg Val Thr Gly Phe Ser Ile Ile Gly
                100                 105                 110

Gly Glu His Arg Leu Thr Asn Tyr Lys Ser Val Thr Thr Val His Arg
            115                 120                 125

Phe Glu Lys Glu Asn Arg Ile Trp Thr Val Val Leu Glu Ser Tyr Val
            130                 135                 140

Val Asp Met Pro Glu Gly Asn Ser Glu Asp Asp Thr Arg Met Phe Ala
145                 150                 155                 160

Asp Thr Val Val Lys Leu Asn Leu Gln Lys Leu Ala Thr Val Ala Glu
                165                 170                 175

Ala Met Ala Arg Asn Ser Gly Asp Gly Ser Gly Ser Gln Val Thr
            180                 185                 190
```

For position F61 (corresponding to the position in SEQ ID NO:1), hypersensitive mutations will include F61L or F61M. For position V81 (corresponding to the position in SEQ ID NO:1), hypersensitive mutations will include V81I or V81Y. For position I110 (corresponding to the position in SEQ ID NO:1), hypersensitive mutations will include I110C or I10S. As some native PYR/PYL polypeptides have a valine at the position corresponding to I110 of SEQ ID NO:1, in some embodiments where position I110 is mutated, the native amino acid will be valine, subsequently mutated to C or S. For position E141 (corresponding to the position in SEQ ID NO:1), hypersensitive mutations will include E141C, E141I, E141L, E141M, E141N, E141T, E141V, E141W, or E141Y. For position A160 (corresponding to the position in SEQ ID NO:1), hypersensitive mutations will include A160C, A160I or A160V. As some native PYR/PYL polypeptides have a valine at the position corresponding to A160 of SEQ ID NO:1, in some embodiments where position A160 is mutated, the native amino acid will be valine, subsequently mutated to C or I.

Figure 3:
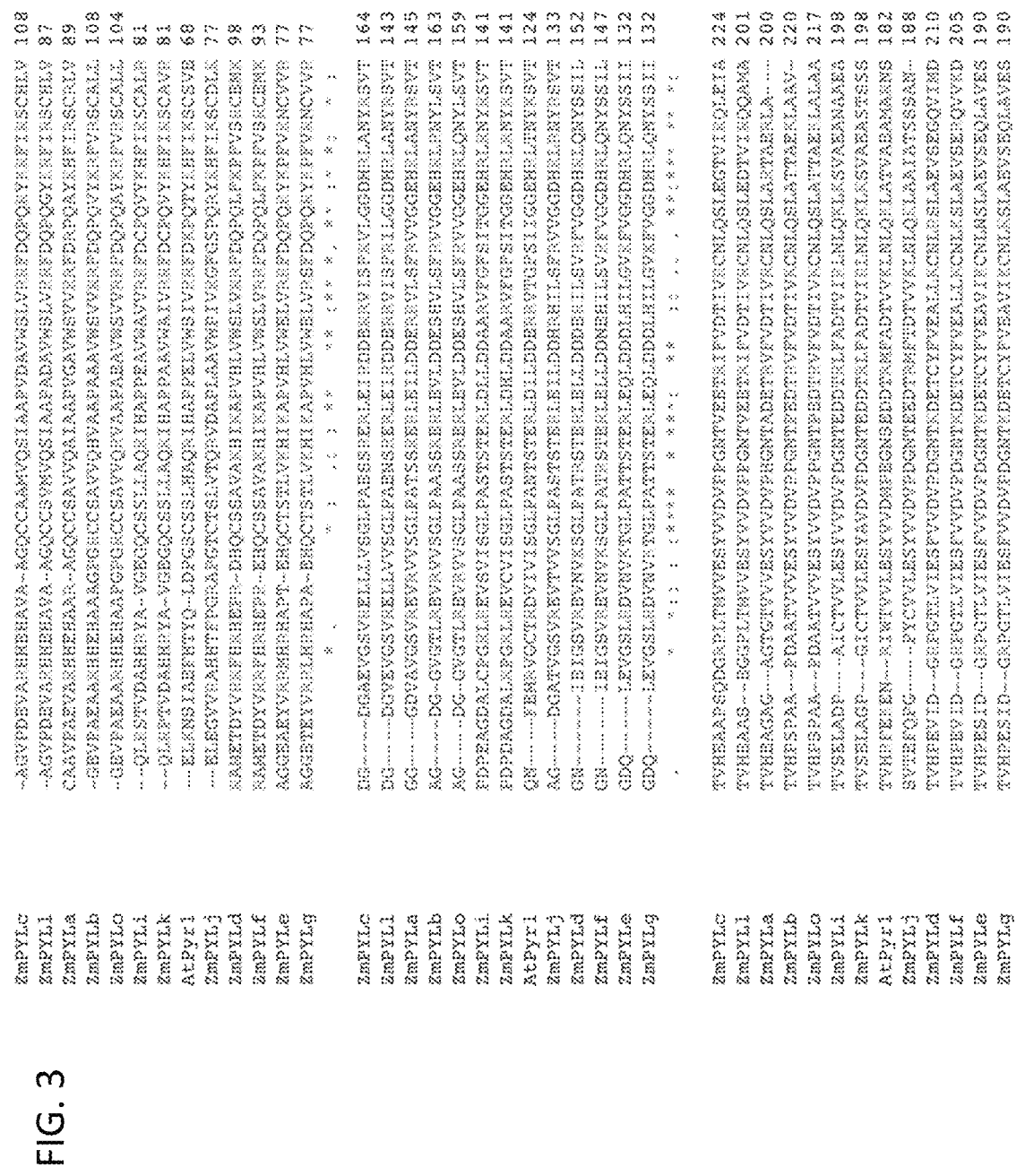

Any of the mutations described herein can be made in any wildtype PYR/PYL polypeptide, for example, in the polypeptides of any of SEQ ID NOs:1-119 or in polypeptides substantially identical to any of SEQ ID NOs:1-119 or comprising any of SEQ ID NOs: 120-123. Analogous amino acid substitutions can be made, for example, in PYR/PYL receptors other than PYR1 by aligning the PYR/PYL receptor polypeptide sequence to be mutated with the PYR1 receptor polypeptide sequence as set forth in SEQ ID NO:1. As a non-limiting example, an amino acid substitution in PYL2 that is analogous to the amino acid substitution V81I in PYR1 as set forth in SEQ ID NO:1 can be determined by aligning the amino acid sequences of PYL2 (SEQ ID NO:3) and PYR1 (SEQ ID NO:1) and identifying position V85 in PYL2 as aligning with amino acid position V81 of PYR1 (SEQ ID NO:1). Analogous amino acid positions in PYR/PYL receptors are shown in FIGS. 2 and 3. As an example, SEQ ID NOS:155-361 represent maize PYR/PYL polypeptides containing the hypersensitive mutations described herein. It will be appreciated that the polypeptides can be further mutated (e.g., with conservative mutations, e.g., outside active sites) without substantially affecting activity. Accordingly, in some embodiments, the hypersensitive polypeptides as described herein comprise a sequence substantially (e.g., at least 70%, 75%, 80%, 85%, 90%, 95%, 98%) identical to the entire sequence of one of SEQ ID NOs: 155-361.

The extent to which one or more amino acid substitutions in the PYR/PYL receptor activity renders the receptor hypersensitive to ABA can be quantitatively measured, for example by assaying phosphatase activity in the presence of ABA and the PYR/PYL receptor comprising one or more amino acid substitutions and comparing the phosphatase activity to that of a control PYR/PYL receptor. A control PYR/PYL receptor will typically be the wildtype PYR/PYL polypeptide most similar to the mutated a PYR/PYL polypeptide. In some embodiments, e.g., when the starting protein is not a wildtype PYR/PYL polypeptide, the control PYR/PYL polypeptide can be substantially identical (e.g., at least 90, 95, or 98% identical) to the test PYR/PYL polypeptide (i.e., suspected of being hypersensitive) and having the wildtype amino acid at the corresponding position. For example, if the mutant PYR/PYL receptor has a mutation of F61X, where X is any non-F amino acid, the control would have F61 at the same position but would otherwise be identical to the mutant PYR/PYL receptor. If the mutant PYR/PYL receptor has a mutation of V81X, where X is any non-V amino acid, the control would have V81 at the same position but would otherwise be identical to the mutant PYR/PYL receptor. If the mutant PYR/PYL receptor has a mutation of I110X, where X is any non-I, non-V amino acid, the control would have I110 or V at the same position but would otherwise be identical to the mutant PYR/PYL receptor. If the mutant PYR/PYL receptor has a mutation of E141X, where X is any non-E amino acid, the control would have E141 at the same position but would otherwise be identical to the mutant PYR/PYL receptor. If the mutant PYR/PYL receptor has a mutation of A160X, where X is any non-A, non-V amino acid, the control would have A160 or valine at the same position but would otherwise be identical to the mutant PYR/PYL receptor.

In some embodiments, a mutated PYR/PYL receptor polypeptide comprises two or more amino acid substitutions as described herein. In some embodiments, the two or more amino acid substitutions corresponding to, F61X, V81X, I110X, E141X, and A160X, in PYR1 as set forth in SEQ ID NO:1, where X is the amino acid indicated herein as resulting in hypersensitivity.

Embodiments of the present invention provide for use of the above proteins and/or nucleic acid sequences, encoding such polypeptides, in the methods and compositions (e.g., expression cassettes, transgenic plants, plants with in situ PYR/PYL modifications, etc.) of the present invention. The isolation of a polynucleotide sequence encoding a plant wild-type PYR/PYL receptor (e.g., from plants where PYR/PYL sequences have not yet been identified) may be accomplished by a number of techniques. For instance, oligonucleotide probes based on the PYR/PYL coding sequences disclosed (e.g., as listed in the SEQUENCE LISTING) here can be used to identify the desired wild-type PYR/PYL gene in a cDNA or genomic DNA library. To construct genomic libraries, large segments of genomic DNA are generated by random fragmentation, e.g., using restriction endonucleases, and are ligated with vector DNA to form concatemers that can be packaged into the appropriate vector. To prepare a cDNA library, mRNA is isolated from the desired tissue, such as a leaf from a particular plant species, and a cDNA library containing the gene transcript of interest is prepared from the mRNA. Alternatively, cDNA may be prepared from mRNA extracted from other tissues in which PYR/PYL gene is expressed.

The cDNA or genomic library can then be screened using a probe based upon the sequence of a PYR/PYL gene disclosed here. Probes may be used to hybridize with genomic DNA or cDNA sequences to isolate homologous genes in the same or different plant species. Alternatively, antibodies raised against a polypeptide can be used to screen an mRNA expression library.

Alternatively, the nucleic acids encoding PYR/PYL can be amplified from nucleic acid samples using amplification techniques. For instance, polymerase chain reaction (PCR) technology can be used to amplify the coding sequences of PYR/PYL directly from genomic DNA, from cDNA, from genomic libraries or cDNA libraries. PCR and other in vitro amplification methods may also be useful, for example, to clone polynucleotide sequences encoding PYR/PYL to be expressed, to make nucleic acids to use as probes for detecting the presence of the desired mRNA in samples, for nucleic acid sequencing, or for other purposes. For a general overview of PCR see *PCR Protocols: A Guide to Methods and Applications* (Innis, M., Gelfand, D., Sninsky, J. and White, T., eds.), Academic Press, San Diego (1990). Appropriate primers and probes for identifying sequences from plant tissues are generated from comparisons of the sequences provided here with other related genes.

In some embodiments, the partial or entire genome of a number of plants has been sequenced and open reading frames identified. By a BLAST search, one can identify the coding sequence for wild-type PYR/PYL in various plants.

III. Methods of Making Hypersensitive PYR/PYL Receptor Polypeptides

In another aspect, the present invention provides for methods of making ABA hypersensitive PYR/PYL receptor polypeptides comprising one or more amino acid substitutions. In some embodiments, the method comprises mutagenizing a wild-type PYR/PYL receptor and determining whether the mutagenized PYR/PYL receptor is hypersensitive to ABA.

Mutated PYR/PYL receptor polypeptides can be constructed by mutating the DNA sequences that encode the corresponding wild-type PYR/PYL receptor polypeptide (e.g., a wild-type PYR/PYL polypeptide of any of SEQ ID NOs:1-119, having any of SEQ ID NO:s 120-123, or a corresponding variant from which the mutant PYR/PYL receptor polypeptide of the invention is derived), such as by using site-directed or random mutagenesis. Nucleic acid molecules encoding the wild-type PYR/PYL receptor polypeptide can be mutated by a variety of polymerase chain reaction (PCR) techniques well-known to one of ordinary skill in the art. (See, e.g., *PCR Strategies* (M. A. Innis, D. H.

Gelfand, and J. J. Sninsky eds., 1995, Academic Press, San Diego, Calif.) at Chapter 14; *PCR Protocols: A Guide to Methods and Applications* (M. A. Innis, D. H. Gelfand, J. J. Sninsky, and T. J. White eds., Academic Press, N Y, 1990).

As a non-limiting example, mutagenesis may be accomplished using site-directed mutagenesis, in which point mutations, insertions, or deletions are made to a DNA template. Kits for site-directed mutagenesis are commercially available, such as the QuikChange Site-Directed Mutagenesis Kit (Stratagene). Briefly, a DNA template to be mutagenized is amplified by PCR according to the manufacturer's instructions using a high-fidelity DNA polymerase (e.g., Pfu Turbo™) and oligonucleotide primers containing the desired mutation. Incorporation of the oligonucleotides generates a mutated plasmid, which can then be transformed into suitable cells (e.g., bacterial or yeast cells) for subsequent screening to confirm mutagenesis of the DNA.

As another non-limiting example, mutagenesis may be accomplished by means of error-prone PCR amplification (ePCR), which modifies PCR reaction conditions (e.g., using error-prone polymerases, varying magnesium or manganese concentration, or providing unbalanced dNTP ratios) in order to promote increased rates of error in DNA replication. Kits for ePCR mutagenesis are commercially available, such as the GeneMorph® PCR Mutagenesis kit (Stratagene) and Diversify® PCR Random Mutagenesis Kit (Clontech). Briefly, DNA polymerase (e.g., Taq polymerase), salt (e.g., MgCl2, MgSO4, or MnSO4), dNTPs in unbalanced ratios, reaction buffer, and DNA template are combined and subjected to standard PCR amplification according to manufacturer's instructions. Following ePCR amplification, the reaction products are cloned into a suitable vector to construct a mutagenized library, which can then be transformed into suitable cells (e.g., yeast cells) for subsequent screening (e.g., via a two-hybrid screen) as described below.

Alternatively, mutagenesis can be accomplished by recombination (i.e. DNA shuffling). Briefly, a shuffled mutant library is generated through DNA shuffling using in vitro homologous recombination by random fragmentation of a parent DNA followed by reassembly using PCR, resulting in randomly introduced point mutations. Methods of performing DNA shuffling are known in the art (see, e.g., Stebel, S. C. et al., *Methods Mol Biol* 352:167-190 (2007)).

Optionally, multiple rounds of mutagenesis may be performed in order to improve the efficiency of mutant proteins isolated. Thus, in some embodiments, PYR/PYL mutants isolated from ePCR and subsequent screening may be pooled and used as templates for later rounds of mutagenesis.

In some embodiments, the variants are generated by exposing a plant of plant seeds or cells to a mutagen selecting the plant or cell carrying a hypersensitive PYR/PYL polypeptide as described herein by phenotype or genotype. Examples of mutagens include, e.g., chemical mutagens (e.g., EMS) or radiological mutagens. Variants having a desired mutation can be selected based on phenotype of genotype (e.g., by using TILLING techniques).

In some embodiments, the method comprises mutagenizing a wild-type PYR/PYL receptor in situ and determining whether the mutagenized PYR/PYL receptor is hypersensitive to ABA. Mutated PYR/PYL receptor polypeptides can be constructed by mutating the DNA sequences that encode the corresponding wild-type PYR/PYL receptor polypeptide (e.g., a wild-type PYR/PYL polypeptide of any of SEQ ID NOs:1-119, having any of SEQ ID NO:s 120-123, or a corresponding variant from which the mutant PYR/PYL receptor polypeptide of the invention is derived), such as by using site-directed or random mutagenesis.

IV. Screening for Hypersensitive PYR/PYL Receptor Polypeptides

The hypersensitivity of the mutant PYR/PYL receptors described herein can be measured in several alternative ways. When expressed in yeast, most wild-type PYR/PYL receptors will only bind to the type 2 protein phosphatase (PP2C) HAB1 (or other PP2Cs) when the appropriate yeast cells are grown in the presence of ABA. Thus, in some embodiments, hypersensitivity can be measured by determining the ability of a PYR/PYL mutant receptor, expressed in yeast, to bind to and inactivate PP2C in yeast to a greater extent than a control PYR/PYL receptor expressed in yeast. In some embodiments, the hypersensitive mutant PYR/PYL receptor comprises mutations that result in the mutated receptor inhibiting the activity of the PP2C in a phosphatase assay in the presence of ABA at least about 10%, at least about 20%, at least about 30%, at least about 40%, at least about 50%, at least about 60%, at least about 70%, at least about 80% or more as compared to a wild-type or other control PYR/PYL receptor in the presence of the same concentration of ABA. Several test concentrations ranging from low nM to low μM could be conducted to infer ICso values and the ICso values of hypersensitive mutants are substantially lower than appropriate wild type controls.

Alternatively, cell-based or plant-based methods of screening can be used. For example, cells that naturally express a wild-type PYR/PYL receptor polypeptide or that recombinantly express a wild-type or mutated PYR/PYL receptor polypeptide can be used. In some embodiments, the cells used are plant cells, animal cells, bacterial cells, fungal cells, including but not limited to yeast cells, insect cells, or mammalian cells. In general terms, the screening methods involve comparing the activity of a mutated PYR/PYL receptor polypeptide to the activity of a wild-type PYR/PYL receptor polypeptide in the presence of ABA, e.g., by comparing ABA-regulated gene expression in the wild-type and mutant PYR/PYL receptor-expressing cells or plants.

One exemplary assay involves testing whether a mutated PYR/PYL receptor can bind to a type 2 protein phosphatase (PP2C) (e.g., Homology to ABI1 (HAB1)) in the presence of ABA. Binding assays can involve contacting a mutated PYR/PYl receptor polypeptide with a PP2C and allowing sufficient time for the PYR/PYL receptor and PP2C to form a binding complex. Any binding complexes formed can be detected using any of a number of established analytical techniques. Protein binding assays include, but are not limited to, methods that measure co-precipitation or co-migration on non-denaturing SDS-polyacrylamide gels, and co-migration on Western blots (see, e.g., Bennet, J. P. and Yamamura, H. I. (1985) "Neurotransmitter, Hormone or Drug Receptor Binding Methods," in *Neurotransmitter Receptor Binding* (Yamamura, H. I., et al., eds.), pp. 61-89. Other binding assays involve the use of mass spectrometry or NMR techniques to identify molecules bound to the PYR/PYL polypeptide. The PYR/PYL polypeptide protein utilized in such assays can be naturally expressed, cloned or synthesized.

In some embodiments, mammalian or yeast two-hybrid approaches (see, e.g., Bartel, P. L. et. al. *Methods Enzymol*, 254:241 (1995)) can be used to identify polypeptides or other molecules that interact or bind when expressed together in a cell. In some embodiments, a hypersensitive PYR/PYL polypeptide is identified in a two-hybrid assay between a PYR/PYL polypeptide and a PP2C polypeptide, wherein the PYR/PYL polypeptide and the PP2C bind in the presence of ABA.

In another exemplary assay, the level of basal activity of a mutated PYR/PYL receptor polypeptide (i.e., level of activity in the absence of ABA) can be determined using an enzymatic phosphatase assay, in which the PYR/PYL receptor and PP2C are incubated in the presence of ABA. In this type of assay, a decrease in phosphatase activity in the presence of ABA to a greater extent than occurred for a control PYR/PYL receptor is indicative of hypersensitive PYR/PYL receptor. A decrease in phosphatase activity can be determined and quantified using any detection reagent known in the art, e.g., a colorimetric detection reagent such as para-nitrophenylphosphate.

Hypersensitive PYR/PYL receptor polypeptides that are initially identified by any of the foregoing screening methods can be further tested to validate the apparent activity and/or determine other biological effects of the hypersensitive PYR/PYL receptor polypeptide. In some cases, the PYR/PYL receptor polypeptide is tested for the ability to affect plant stress (e.g., drought tolerance and/or high salt tolerance), seed germination, or another phenotype affected by ABA. A number of such assays and phenotypes are known in the art and can be employed according to the methods of the invention.

V. Recombinant Expression Vectors

Once a polynucleotide encoding a mutated PYR/PYL receptor polypeptide is obtained, it can also be used to prepare an expression cassette for expressing the mutated PYR/PYL receptor polypeptide in a transgenic plant, directed by a heterologous promoter. Increased expression of mutated PYR/PYL polynucleotide is useful, for example, to produce plants that selectively activate PYR/PYL receptors, thus enhancing stress tolerance.

Any of a number of means well known in the art can be used to drive mutated PYR/PYL activity or expression in plants. Any organ can be targeted, such as shoot vegetative organs/structures (e.g. leaves, stems and tubers), roots, flowers and floral organs/structures (e.g. bracts, sepals, petals, stamens, carpels, anthers and ovules), seed (including embryo, endosperm, and seed coat) and fruit. Alternatively, the mutated PYR/PYL polynucleotide can be expressed specifically in certain cell and/or tissue types within one or more organs (e.g., guard cells in leaves using a guard cell-specific promoter). Alternatively, the mutated PYR/PYL polynucleotide can be expressed constitutively (e.g., using the CaMV 35S promoter).

To use a polynucleotide sequence for a mutated PYR/PYL receptor polypeptide in the above techniques, recombinant DNA vectors suitable for transformation of plant cells are prepared. Techniques for transforming a wide variety of higher plant species are well known and described in the technical and scientific literature. See, e.g., Weising et al. *Ann. Rev. Genet.* 22:421-477 (1988). A DNA sequence coding for the mutated PYR/PYL receptor polypeptide preferably will be combined with transcriptional and translational initiation regulatory sequences which will direct the transcription of the sequence from the gene in the intended tissues of the transformed plant.

For example, a plant promoter fragment may be employed to direct expression of the mutated PYR/PYL polynucleotide in all tissues of a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumafaciens*, and other transcription initiation regions from various plant genes known to those of skill.

Alternatively, the plant promoter may direct expression of the mutated PYR/PYL receptor protein in a specific tissue (tissue-specific promoters) or may be otherwise under more precise environmental control (inducible promoters). Examples of tissue-specific promoters under developmental control include promoters that initiate transcription only in certain tissues, such as leaves or guard cells (including but not limited to those described in WO 2005/085449; U.S. Pat. No. 6,653,535; Li et al., *Sci China C Life Sci.* 2005 April; 48(2):181-6; Husebye, et al., *Plant Physiol*, April 2002, Vol. 128, pp. 1180-1188; and Plesch, et al., *Gene*, Volume 249, Number 1, 16 May 2000, pp. 83-89(7)). Examples of environmental conditions that may affect transcription by inducible promoters include anaerobic conditions, elevated temperature, or the presence of light.

If proper protein expression is desired, a polyadenylation region at the 3'-end of the coding region should be included. The polyadenylation region can be derived from a naturally occurring PYR/PYL gene, from a variety of other plant genes, or from T-DNA.

The vector comprising the sequences (e.g., promoters or PYR/PYL coding regions) will typically comprise a marker gene that confers a selectable phenotype on plant cells. For example, the marker may encode biocide resistance, particularly antibiotic resistance, such as resistance to kanamycin, G418, bleomycin, hygromycin, or herbicide resistance, such as resistance to chlorosluforon or Basta.

In some embodiments, the mutated PYR/PYL nucleic acid sequence is expressed recombinantly in plant cells. A variety of different expression constructs, such as expression cassettes and vectors suitable for transformation of plant cells, can be prepared. Techniques for transforming a wide variety of higher plant species are well known and described in the technical and scientific literature. See, e.g., Weising et al. *Ann. Rev. Genet.* 22:421-477 (1988). A DNA sequence coding for a PYR/PYL protein can be combined with cis-acting (promoter) and trans-acting (enhancer) transcriptional regulatory sequences to direct the timing, tissue type and levels of transcription in the intended tissues of the transformed plant. Translational control elements can also be used.

Embodiments of the present invention also provide for a mutated PYR/PYL nucleic acid operably linked to a promoter which, in some embodiments, is capable of driving the transcription of the PYR/PYL coding sequence in plants. The promoter can be, e.g., derived from plant or viral sources. The promoter can be, e.g., constitutively active, inducible, or tissue specific. In construction of recombinant expression cassettes, vectors, transgenics, of the invention, a different promoters can be chosen and employed to differentially direct gene expression, e.g., in some or all tissues of a plant or animal.

Constitutive Promoters

A fragment can be employed to direct expression of a mutated PYR/PYL nucleic acid in all transformed cells or tissues, e.g., as those of a regenerated plant. The term "constitutive regulatory element" means a regulatory element that confers a level of expression upon an operatively linked nucleic acid molecule that is relatively independent of the cell or tissue type in which the constitutive regulatory element is expressed. A constitutive regulatory element that is expressed in a plant generally is widely expressed in a large number of cell and tissue types. Promoters that drive expression continuously under physiological conditions are referred to as "constitutive" promoters and are active under most environmental conditions and states of development or cell differentiation.

A variety of constitutive regulatory elements useful for ectopic expression in a transgenic plant are well known in the art. The cauliflower mosaic virus 35S (CaMV 35S) promoter, for example, is a well-characterized constitutive regulatory element that produces a high level of expression in all plant tissues (Odell et al., *Nature* 313:810-812 (1985)). The CaMV 35S promoter can be particularly useful due to its activity in numerous diverse plant species (Benfey and Chua, *Science* 250:959-966 (1990); Futterer et al., *Physiol. Plant* 79:154 (1990); Odell et al., supra, 1985). A tandem 35S promoter, in which the intrinsic promoter element has been duplicated, confers higher expression levels in comparison to the unmodified 35S promoter (Kay et al., *Science* 236:1299 (1987)). Other useful constitutive regulatory elements include, for example, the cauliflower mosaic virus 19S promoter; the Figwort mosaic virus promoter; and the nopaline synthase (nos) gene promoter (Singer et al., *Plant Mol. Biol.* 14:433 (1990); An, *Plant Physiol.* 81:86 (1986)).

Additional constitutive regulatory elements including those for efficient expression in monocots also are known in the art, for example, the pEmu promoter and promoters based on the rice Actin-1 5' region (Last et al., *Theor. Appl. Genet.* 81:581 (1991); Mcelroy et al., *Mol. Gen. Genet.* 231:150 (1991); Mcelroy et al., *Plant Cell* 2:163 (1990)). Chimeric regulatory elements, which combine elements from different genes, also can be useful for ectopically expressing a nucleic acid molecule encoding a mutated PYR/PYL receptor protein (Comai et al., *Plant Mol. Biol.* 15:373 (1990)).

Other examples of constitutive promoters include the 1'- or 2'-promoter derived from T-DNA of *Agrobacterium tumafaciens* (see, e.g., Mengiste (1997) supra; O'Grady (1995) *Plant Mol. Biol.* 29:99-108); actin promoters, such as the *Arabidopsis* actin gene promoter (see, e.g., Huang (1997) Plant Mol. Biol. 1997 33:125-139); alcohol dehydrogenase (Adh) gene promoters (see, e.g., Millar (1996) *Plant Mol. Biol.* 31:897-904); ACT11 from *Arabidopsis* (Huang et al. *Plant Mol. Biol.* 33:125-139 (1996)), Cat3 from *Arabidopsis* (GenBank No. U43147, Zhong et al., *Mol. Gen. Genet.* 251:196-203 (1996)), the gene encoding stearoyl-acyl carrier protein desaturase from *Brassica napus* (Genbank No. X74782, Solocombe et al. *Plant Physiol.* 104:1167-1176 (1994)), GPc1 from maize (GenBank No. X15596, Martinez et al. *J. Mol. Biol* 208:551-565 (1989)), Gpc2 from maize (GenBank No. U45855, Manjunath et al., *Plant Mol. Biol.* 33:97-112 (1997)), other transcription initiation regions from various plant genes known to those of skill. See also Holtorf *Plant Mol. Biol.* 29:637-646 (1995).

Inducible Promoters

Alternatively, a plant promoter may direct expression of the mutated PYR/PYL polynucleotide under the influence of changing environmental conditions or developmental conditions. Examples of environmental conditions that may affect transcription by inducible promoters include anaerobic conditions, elevated temperature, drought, or the presence of light. Such promoters are referred to herein as "inducible" promoters. In some embodiments, an inducible promoter is one that is induced by one or more environmental stressors, including but not limited to, drought, freezing cold, and high salt. For example, the invention can incorporate a drought-specific promoter such as a drought-inducible promoter of maize (e.g., the maize rab17 drought-inducible promoter (Vilardell et al. (1991) *Plant Mol. Biol.* 17:985-993; Vilardell et al. (1994) *Plant Mol. Biol.* 24:561-569)); or alternatively a cold, drought, and high salt inducible promoter from potato (Kirch (1997) *Plant Mol. Biol.* 33:897-909) or from *Arabidopsis* (e.g., the rd29A promoter (Kasuga et al. (1999) *Nature Biotechnology* 17:287-291). Other environmental stress-inducible promoters include promoters from the following genes: Rab21, Wsi18, Lea3, Uge1, Dip1, and R1G1B in rice (Yi et al. (2010) *Planta* 232:743-754).

In some embodiments, a plant promoter is a stress-inducible promoter (e.g., a drought-, cold-, or salt-inducible promoter) that comprises a dehydration-responsive element (DRE) and/or an ABA-responsive element (ABRE), including but not limited to the rd29A promoter.

Alternatively, plant promoters which are inducible upon exposure to plant hormones, such as auxins, are used to express the mutated PYR/PYL polynucleotide. For example, the invention can use the auxin-response elements E1 promoter fragment (AuxREs) in the soybean (*Glycine max* L.) (Liu (1997) *Plant Physiol.* 115:397-407); the auxin-responsive *Arabidopsis* GST6 promoter (also responsive to salicylic acid and hydrogen peroxide) (Chen (1996) *Plant J.* 10: 955-966); the auxin-inducible parC promoter from tobacco (Sakai (1996) 37:906-913); a plant biotin response element (Streit (1997) *Mol. Plant Microbe Interact.* 10:933-937); and, the promoter responsive to the stress hormone abscisic acid (Sheen (1996) *Science* 274:1900-1902).

Plant promoters inducible upon exposure to chemicals reagents that may be applied to the plant, such as herbicides or antibiotics, are also useful for expressing the mutated PYR/PYL polynucleotide. For example, the maize Int-2 promoter, activated by benzenesulfonamide herbicide safeners, can be used (De Veylder (1997) *Plant Cell Physiol.* 38:568-577); application of different herbicide safeners induces distinct gene expression patterns, including expression in the root, hydathodes, and the shoot apical meristem. A PYR/PYL coding sequence can also be under the control of, e.g., a tetracycline-inducible promoter, e.g., as described with transgenic tobacco plants containing the *Avena sativa* L. (oat) arginine decarboxylase gene (Masgrau (1997) *Plant J.* 11:465-473); or, a salicylic acid-responsive element (Stange (1997) *Plant J.* 11:1315-1324; Uknes et al., *Plant Cell* 5:159-169 (1993); Bi et al., *Plant J.* 8:235-245 (1995)).

Examples of useful inducible regulatory elements include copper-inducible regulatory elements (Mett et al., *Proc. Natl. Acad. Sci. USA* 90:4567-4571 (1993); Furst et al., *Cell* 55:705-717 (1988)); tetracycline and chlor-tetracycline-inducible regulatory elements (Gatz et al., *Plant J.* 2:397-404 (1992); Roder et al., *Mol. Gen. Genet.* 243:32-38 (1994); Gatz, *Meth. Cell Biol.* 50:411-424 (1995)); ecdysone inducible regulatory elements (Christopherson et al., *Proc. Natl. Acad. Sci. USA* 89:6314-6318 (1992); Kreutzweiser et al., *Ecotoxicol. Environ. Safety* 28:14-24 (1994)); heat shock inducible regulatory elements (Takahashi et al., *Plant Physiol.* 99:383-390 (1992); Yabe et al., *Plant Cell Physiol.* 35:1207-1219 (1994); Ueda et al., *Mol. Gen. Genet.* 250: 533-539 (1996)); and lac operon elements, which are used in combination with a constitutively expressed lac repressor to confer, for example, IPTG-inducible expression (Wilde et al., *EMBO J.* 11:1251-1259 (1992)). An inducible regulatory element useful in the transgenic plants of the invention also can be, for example, a nitrate-inducible promoter derived from the spinach nitrite reductase gene (Back et al., *Plant Mol. Biol.* 17:9 (1991)) or a light-inducible promoter, such as that associated with the small subunit of RuBP carboxylase or the LHCP gene families (Feinbaum et al., *Mol. Gen. Genet.* 226:449 (1991); Lam and Chua, *Science* 248:471 (1990)).

Tissue-Specific Promoters

Alternatively, the plant promoter may direct expression of the mutated PYR/PYL polynucleotide in a specific tissue (tissue-specific promoters). Tissue specific promoters are transcriptional control elements that are only active in particular cells or tissues at specific times during plant development, such as in vegetative tissues or reproductive tissues.

Examples of tissue-specific promoters under developmental control include promoters that initiate transcription only (or primarily only) in certain tissues, such as vegetative tissues, e.g., roots or leaves, or reproductive tissues, such as fruit, ovules, seeds, pollen, pistols, flowers, or any embryonic tissue, or epidermis or mesophyll. Reproductive tissue-specific promoters may be, e.g., ovule-specific, embryo-specific, endosperm-specific, integument-specific, seed and seed coat-specific, pollen-specific, petal-specific, sepal-specific, or some combination thereof. In some embodiments, the promoter is cell-type specific, e.g., guard cell-specific.

Epidermal-specific promoters include, for example, the *Arabidopsis* LTP1 promoter (Thoma et al. (1994) *Plant Physiol.* 105(1):35-45), the CER1 promoter (Aarts et al. (1995) *Plant Cell* 7:2115-27), and the CER6 promoter (Hooker et al. (2002) *Plant Physiol* 129:1568-80), and the orthologous tomato LeCER6 (Vogg et al. (2004) *J. Exp Bot.* 55:1401-10).

Guard cell-specific promoters include, for example, the DGP1 promoter (Li et al. (2005) *Science China C Life Sci.* 48:181-186).

Other tissue-specific promoters include seed promoters. Suitable seed-specific promoters are derived from the following genes: MAC1 from maize (Sheridan (1996) *Genetics* 142:1009-1020); Cat3 from maize (GenBank No. L05934, Abler (1993) *Plant Mol. Biol.* 22:10131-1038); vivparous-1 from *Arabidopsis* (Genbank No. U93215); atmyc1 from *Arabidopsis* (Urao (1996) *Plant Mol. Biol.* 32:571-57; Conceicao (1994) *Plant* 5:493-505); napA from *Brassica napus* (GenBank No. J02798, Josefsson (1987) JBL 26:12196-1301); and the napin gene family from *Brassica napus* (Sjodahl (1995) *Planta* 197:264-271).

A variety of promoters specifically active in vegetative tissues, such as leaves, stems, roots and tubers, can also be used to express polynucleotides encoding mutated PYR/PYL receptor polypeptides. For example, promoters controlling patatin, the major storage protein of the potato tuber, can be used, see, e.g., Kim (1994) *Plant Mol. Biol.* 26:603-615; Martin (1997) *Plant J.* 11:53-62. The ORF13 promoter from *Agrobacterium rhizogenes* that exhibits high activity in roots can also be used (Hansen (1997) *Mol. Gen. Genet.* 254:337-343. Other useful vegetative tissue-specific promoters include: the tarin promoter of the gene encoding a globulin from a major taro (*Colocasia esculenta* L. Schott) corm protein family, tarin (Bezerra (1995) *Plant Mol. Biol.* 28:137-144); the curculin promoter active during taro corm development (de Castro (1992) *Plant Cell* 4:1549-1559) and the promoter for the tobacco root-specific gene TobRB7, whose expression is localized to root meristem and immature central cylinder regions (Yamamoto (1991) *Plant Cell* 3:371-382).

Leaf-specific promoters, such as the ribulose biphosphate carboxylase (RBCS) promoters, can also be used. For example, the tomato RBCS1, RBCS2 and RBCS3A genes are expressed in leaves and light-grown seedlings, only RBCS1 and RBCS2 are expressed in developing tomato fruits (Meier (1997) *FEBS Lett.* 415:91-95). A ribulose bisphosphate carboxylase promoters expressed almost exclusively in mesophyll cells in leaf blades and leaf sheaths at high levels, described by Matsuoka (1994) *Plant J.* 6:311-319, can be used. Another leaf-specific promoter is the light harvesting chlorophyll a/b binding protein gene promoter, see, e.g., Shiina (1997) *Plant Physiol.* 115:477-483; Casal (1998) *Plant Physiol.* 116:1533-1538. The *Arabidopsis thaliana* myb-related gene promoter (Atmyb5) described by Li (1996) *FEBS Lett.* 379:117-121, is leaf-specific. The Atmyb5 promoter is expressed in developing leaf trichomes, stipules, and epidermal cells on the margins of young rosette and cauline leaves, and in immature seeds. Atmyb5 mRNA appears between fertilization and the 16 cell stage of embryo development and persists beyond the heart stage. A leaf promoter identified in maize by Busk (1997) *Plant J.* 11:1285-1295, can also be used.

Another class of useful vegetative tissue-specific promoters are meristematic (root tip and shoot apex) promoters. For example, the "SHOOTMERISTEMLESS" and "SCARECROW" promoters, which are active in the developing shoot or root apical meristems, described by Di Laurenzio (1996) *Cell* 86:423-433; and, Long (1996) *Nature* 379:66-69; can be used. Another useful promoter is that which controls the expression of 3-hydroxy-3-methylglutaryl coenzyme A reductase HMG2 gene, whose expression is restricted to meristematic and floral (secretory zone of the stigma, mature pollen grains, gynoecium vascular tissue, and fertilized ovules) tissues (see, e.g., Enjuto (1995) *Plant Cell.* 7:517-527). Also useful are kn1-related genes from maize and other species which show meristem-specific expression, see, e.g., Granger (1996) *Plant Mol. Biol.* 31:373-378; Kerstetter (1994) *Plant Cell* 6:1877-1887; Hake (1995) *Philos. Trans. R. Soc. Lond. B. Biol. Sci.* 350:45-51. For example, the *Arabidopsis thaliana* KNAT1 promoter (see, e.g., Lincoln (1994) *Plant Cell* 6:1859-1876).

One of skill will recognize that a tissue-specific promoter may drive expression of operably linked sequences in tissues other than the target tissue. Thus, as used herein a tissue-specific promoter is one that drives expression preferentially in the target tissue, but may also lead to some expression in other tissues as well.

In another embodiment, the mutated PYR/PYL polynucleotide is expressed through a transposable element. This allows for constitutive, yet periodic and infrequent expression of the constitutively active polypeptide. The invention also provides for use of tissue-specific promoters derived from viruses including, e.g., the tobamovirus subgenomic promoter (Kumagai (1995) *Proc. Natl. Acad. Sci. USA* 92:1679-1683; the rice tungro bacilliform virus (RTBV), which replicates only in phloem cells in infected rice plants, with its promoter which drives strong phloem-specific reporter gene expression; the cassava vein mosaic virus (CVMV) promoter, with highest activity in vascular elements, in leaf mesophyll cells, and in root tips (Verdaguer (1996) *Plant Mol. Biol.* 31:1129-1139).

VI. Production of Plants Comprising Hypersensitive Mutations

In another aspect, the present invention provides for transgenic plants comprising recombinant expression cassettes for expressing a hypersensitive PYR/PYL receptor protein as described herein in a plant. In some embodiments, a transgenic plant is generated that contains a complete or partial sequence of a polynucleotide that is derived from a species other than the species of the transgenic plant. It should be recognized that transgenic plants encompass the plant or plant cell in which the expression cassette is introduced as well as progeny of such plants or plant cells that contain the expression cassette, including the progeny that have the expression cassette stably integrated in a chromosome.

A recombinant expression vector comprising a PYR/PYL coding sequence driven by a heterologous promoter may be introduced into the genome of the desired plant host by a variety of conventional techniques. For example, the DNA construct may be introduced directly into the genomic DNA of the plant cell using techniques such as electroporation and microinjection of plant cell protoplasts, or the DNA construct can be introduced directly to plant tissue using ballistic methods, such as DNA particle bombardment. Alternatively, the DNA construct may be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. While transient expression of the constitutively active PYR/PYL receptor is encompassed by the invention, generally expression of construction of the invention will be from insertion of expression cassettes into the plant genome, e.g., such that at least some plant offspring also contain the integrated expression cassette.

Microinjection techniques are also useful for this purpose. These techniques are well known in the art and thoroughly described in the literature. The introduction of DNA constructs using polyethylene glycol precipitation is described in Paszkowski et al. *EMBO J.* 3:2717-2722 (1984). Electroporation techniques are described in Fromm et al. *Proc. Natl. Acad. Sci. USA* 82:5824 (1985). Ballistic transformation techniques are described in Klein et al. *Nature* 327:70-73 (1987).

*Agrobacterium tumefaciens*-mediated transformation techniques, including disarming and use of binary vectors, are well described in the scientific literature. See, for example, Horsch et al. *Science* 233:496-498 (1984), and Fraley et al. *Proc. Natl. Acad. Sci. USA* 80:4803 (1983).

Transformed plant cells derived by any of the above transformation techniques can be cultured to regenerate a whole plant that possesses the transformed genotype and thus the desired phenotype such as enhanced abiotic stress resistance. Such regeneration techniques rely on manipulation of certain phytohormones in a tissue culture growth medium, typically relying on a biocide and/or herbicide marker which has been introduced together with the desired nucleotide sequences. Plant regeneration from cultured protoplasts is described in Evans et al., Protoplasts Isolation and Culture, Handbook of Plant Cell Culture, pp. 124-176, MacMillilan Publishing Company, New York, 1983; and Binding, Regeneration of Plants, Plant Protoplasts, pp. 21-73, CRC Press, Boca Raton, 1985. Regeneration can also be obtained from plant callus, explants, organs, or parts thereof. Such regeneration techniques are described generally in Klee et al. *Ann. Rev. of Plant Phys.* 38:467-486 (1987).

One of skill will recognize that after the expression cassette is stably incorporated in transgenic plants and confirmed to be operable, it can be introduced into other plants by sexual crossing. Any of a number of standard breeding techniques can be used, depending upon the species to be crossed.

The expression cassettes of the invention can be used to confer abiotic stress resistance on essentially any plant. Thus, the invention has use over a broad range of plants, including species from the genera *Asparagus, Atropa, Avena, Brassica, Citrus, Citrullus, Capsicum, Cucumis, Cucurbita, Daucus, Fragaria, Glycine, Gossypium, Helianthus, Heterocallis, Hordeum, Hyoscyamus, Lactuca, Linum, Lolium, Lycopersicon, Malus, Manihot, Majorana, Medicago, Nicotiana, Oryza, Panieum, Pannesetum, Persea, Pisum, Pyrus, Prunus, Raphanus, Secale, Senecio, Sinapis, Solanum, Sorghum, Trigonella, Triticum, Vitis, Vigna*, and, *Zea*. In some embodiments, the plant is selected from the group consisting of rice, maize, wheat, soybeans, cotton, canola, turfgrass, and alfalfa. In some embodiments, the plant is an ornamental plant. In some embodiment, the plant is a vegetable- or fruit-producing plant.

Those of skill will recognize that a number of plant species can be used as models to predict the phenotypic effects of transgene expression in other plants. For example, it is well recognized that both tobacco (*Nicotiana*) and *Arabidopsis* plants are useful models of transgene expression, particularly in other dicots.

In some embodiments, the plants of the invention have enhanced ABA-mediated phenotypes, for example enhanced seed dormancy, as compared to plants that are otherwise identical except for expression of the hypersensitive PYR/PYL receptor polypeptide. Those of skill in the art will recognize that ABA is a well-studied plant hormone and that ABA mediates many changes in characteristics, any of which can be monitored to determine changes in phenotype. In some embodiments, an enhanced ABA-mediated phenotype is manifested by altered timing of seed germination or altered stress (e.g., drought, freezing cold, and/or salt) tolerance.

Abiotic stress resistance can be assayed according to any of a number of well-known techniques. For example, for drought tolerance, plants can be grown under conditions in which less than optimum water is provided to the plant. Drought resistance can be determined by any of a number of standard measures including turgor pressure, growth, yield, and the like. In some embodiments, a transgenic plant expressing a mutated PYR/PYL receptor as described herein has enhanced drought tolerance if the loss of turgor in the transgenic plant is reduced by at least about 10%, 15%, 20%, 25%, 30%, 40%, 50%, 60%, 70%, 80%, 90%, or more as compared to a non-transgenic control plant over a defined period of time (e.g., over the course of 5, 6, 7, 8, 9, 10, 11, 12, 13, 14 days or more, e.g., 3, 4, 5 weeks or more).

In some embodiments, the enhanced ABA-mediated phenotype is enhanced tolerance to moderate or high salinity. Salinity tolerance can be determined by any of a number of standard measures, including germination, growth, yield, or plant survival, leaf injury, premature loss of chlorophyll, and the like. In some embodiments, transgenic plants expressing a mutated PYR/PYL receptor as described herein have enhanced salt tolerance if the survival of the transgenic plants under moderate-salt or high-salt conditions (e.g., about 50 mM, 100 mM, 150 mM, 200 mM, 250 mM, 300 mM NaCl or higher) is increased by at least about 10%, 15%, 20%, 25%, 30%, 40%, 50%, 60%, 70%, 80%, 90%, or more as compared to a non-transgenic control plant over a defined period of time (e.g., over the course of 5, 6, 7, 8, 9, 10, 11, 12, 13, 14 days or more, e.g., 3, 4, 5 weeks or more).

Plant gene manipulations can now be precisely tailored in non-transgenic organisms using the CRISPR/Cas9 genome editing method. In this bacterial antiviral and transcriptional regulatory system, a complex of two small RNAs—the CRISPR-RNA (crRNA) and the trans-activating crRNA (tracrRNA)—directs the nuclease (Cas9) to a specific DNA sequence complementary to the crRNA (Jinek, M., et al. *Science* 337, 816-821 (2012)). Binding of these RNAs to Cas9 involves specific sequences and secondary structures in the RNA. The two RNA components can be simplified into a single element, the single guide-RNA (sgRNA), which is transcribed from a cassette containing a target sequence defined by the user (Jinek, M., et al. *Science* 337, 816-821 (2012)). This system has been used for genome editing in humans, zebrafish, *Drosophila*, mice, nematodes, bacteria, yeast, and plants (Hsu, P. D., et al., *Cell* 157, 1262-1278 (2014)). In this system the nuclease creates double stranded breaks at the target region programmed by the sgRNA. These can be repaired by non-homologous recombination, which often yields inactivating mutations. The breaks can also be repaired by homologous recombination, which enables the system to be used for gene targeted gene replacement (Li, J.-F., et al. *Nat. Biotechnol.* 31, 688-691, 2013; Shan, Q., et al. *Nat. Biotechnol.* 31, 686-688, 2013). The hypersensitive mutations described in this application can be introduced into plants using the CAS9/CRISPR system.

Accordingly, in some embodiments, instead of generating a transgenic plant, a native PYR/PYR coding sequence in a plant or plant cell can be altered in situ to generate a plant or plant cell carrying a polynucleotide encoding a hypersensitive PYR/PYL polypeptide as described herein. For example, in some embodiments, CRISPR technology is used to introduce one or more nucleotide changes into a PYR/PYL coding sequence in situ to change the appropriate codon to make a change corresponding to F61X, V81X, I110X, or V163X of SEQ ID NO:1. The CRISPR/Cas system has been modified for use in prokaryotic and eukaryotic systems for genome editing and transcriptional regulation. The "CRISPR/Cas" system refers to a widespread class of bacterial systems for defense against foreign nucleic acid. CRISPR/Cas systems are found in a wide range of eubacterial and archaeal organisms. CRISPR/Cas systems include type I, II, and III sub-types. Wild-type type II CRISPR/Cas systems utilize the RNA-mediated nuclease, Cas9 in complex with guide and activating RNA to recognize and cleave foreign nucleic acid. Cas9 homologs are found in a wide variety of eubacteria, including, but not limited to bacteria of the following taxonomic groups: Actinobacteria, Aquificae, Bacteroidetes-Chlorobi, Chlamydiae-Verrucomicrobia, Chloroflexi, Cyanobacteria, Firmicutes, Proteobacteria, Spirochaetes, and Thermotogae. An exemplary Cas9 protein is the *Streptococcus pyogenes* Cas9 protein. Additional Cas9 proteins and homologs thereof are described in, e.g., Chylinksi, et al., RNA Biol. 2013 May 1; 10(5): 726-737; Nat. Rev. Microbiol. 2011 June; 9(6): 467-477; Hou, et al., Proc Natl Acad Sci USA. 2013 Sep. 24; 110(39):15644-9; Sampson et al., Nature. 2013 May 9; 497(7448):254-7; and Jinek, et al., Science. 2012 Aug. 17; 337(6096):816-21.

Accordingly, in one aspect, a method is provided of using CRISPR/CAS9 to introduce at least one of the mutation described herein into a plant cell is performed. In some embodiments, a method of altering a (e.g., native) nucleic acid encoding PYR/PYL polypeptide in a plant is provided. In some embodiments, the method comprises introducing into the plant cell containing and expressing a DNA molecule having a target nucleic acid encoding PYR/PYL polypeptide an engineered, non-naturally occurring Clustered Regularly Interspaced Short Palindromic Repeats (CRISPR)-CRISPR associated (Cas) (CRISPR-Cas) system. In some embodiments, the CRISPR-Cas system comprises one or more vectors comprising: a) a first regulatory element operable in a plant cell operably linked to at least one nucleotide sequence encoding a CRISPR-Cas system guide RNA that hybridizes with the target sequence, and b) a second regulatory element operable in a plant cell operably linked to a nucleotide sequence encoding a Type-II Cas9 protein, wherein components (a) and (b) are located on same or different vectors of the system, whereby the guide RNA targets the target sequence and the Cas9 protein cleaves the DNA molecule, whereby at least one of the hypersensitive mutations described herein is introduced into the target nucleic acid encoding the PYR/PYL polypeptide. In some embodiments, the PRY/PYL polypeptide is selected from any of SEQ ID NO:1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, or 119 or a substantially identical polypeptide. In some embodiments, the plant is from a genus selected from *Asparagus, Atropa, Avena, Brassica, Citrus, Citrullus, Capsicum, Cucumis, Cucurbita, Daucus, Fragaria, Glycine, Gossypium, Helianthus, Heterocallis, Hordeum, Hyoscyamus, Lactuca, Linum, Lolium, Lycopersicon, Malus, Manihot, Majorana, Medicago, Nicotiana, Oryza, Panieum, Pannesetum, Persea, Pisum, Pyrus, Prunus, Raphanus, Secale, Senecio, Sinapis, Solanum, Sorghum, Trigonella, Triticum, Vitis, Vigna*, and, *Zea*. In some embodiments, the plant is selected from the group consisting of rice, maize, wheat, and soybean. In some embodiments, the hypersensitive mutation introduced to the target nucleic acid is (corresponding to their position in *Arabidopsis* PYR1 (SEQ ID NO:1)): F61, V81, I110, E141, or A160 or a combination thereof. In some embodiments, no other mutations are introduced into the target nucleic acid. Also provided as a plant or plant cell resulting from the above-described method. Such a plant will contain a non-naturally-occurring nucleic acid sequence encoding the hypersensitive PYR/PYL polypeptide.

VII. PYR/PYL Fusion Proteins

In some embodiments, the hypersensitive PYR/PYL polypeptides described herein are provided as fusion proteins, i.e., translational fusions with one or more fusion partner. In some embodiments, a hypersensitive PYR/PYL polypeptide is fused with a transcriptional activation or modulation domain. A non-limiting example of such a domain is VP16 or VP64. The fusion proteins can further comprise a nuclear localization signal sequence such that the fusion protein, when translated in a eukaryotic host cell, is localized to the cell nucleus. Also provided are polynucleotides encoding such fusion proteins as well as host cells comprising and expressing such polynucleotides. The polynucleotides in such instances will be heterologous to the host cell, i.e., will not be naturally occurring, for example transformed into the cell.

Such fusion proteins are useful, for example, in controlling eukaryotic gene expression in the cell when co-expressed with a sequence-specific DNA binding domain fused with) ABA INSENSITIVE 1 (ABI1) or other proteins having specific binding affinity for PYR/PYL proteins binding ABA. Exemplary sequence-specific DNA binding domains include, but are not limited to zinc-finger proteins, TALENS, transcription factor DNA binding domains, and RNA-guided DNA-binding domains of inactive Cas9 (dCas9). When both fusion proteins are co-expressed in the cell in the presence of ABA, the two fusion proteins will co-localized due to the binding of ABA1 to the ABA-binding PYR/PYL protein, thereby bringing the transcriptional activation or modulation domain in proximity to the target promoter, thereby regulating gene expression. Examples of systems and their use in gene regulation, are described in, e.g., Konermann et al., Nature 500:472-476 (2013) and Liang et al., Science Vol. 4 Issue 164 (2011).

RNA Directed Genome Modification

In one aspect provided herein is a method for introducing a mutation in situ at a PYR/PYL mutation target site in a plant cell genome, as described herein. For example, in some embodiments, the PYR/PYL mutation target site comprises a nucleic acid that encodes for V89 of PYL-E or E149 of PYL. In certain embodiments the method comprises introducing into the plant cell: 1) a CRISPR ribonucleic acid (crRNA) that includes a sequence substantially identical to SEQ ID NOS: 363, 364, 365, 366, 367 or 369; 2) a transacting ribonucleic acid (tracRNA); 3) a nuclease (e.g., Cas9); and 4) a repair nucleic acid that can undergo homologous recombination that contains the mutation. According to the subject method, the crRNA and tracRNA directs the nuclease to the PYR/PYL mutation target site in a plant cell genome. Upon its recruitment, the nuclease (e.g., Cas9) creates a double strand break at the PYR/PYL mutation target site. The double strand break at the PYR/PYL mutation target site facilitates homologous recombination of the repair nucleic acid containing the mutation with a region of the plant cell genome that includes the PYR/PYL mutation target site, thereby introducing the mutation at the PYR/PYL mutation target site.

Mutations can be introduced into any suitable plant cell using the subject method. In some embodiments, the plant cell is a plant embryo. In certain embodiments, the plant cell is a maize plant cell.

Each component of the method can be introduced into the plant cell using any suitable method known in the art. In certain embodiments, the crRNA and tracRNA are introduced into the cell as an expression cassette containing a polynucleotide (i.e., DNA) encoding the crRNA and/or traRNA. In some embodiments, the expression cassette includes an RNA polymerase promoter operably linked to the polynucleotide encoding the crRNA and/or traRNA, thereby allowing transcription of the crRNA and/or traRNA. In some embodiments, the Cas9 is introduced into the cell as an expression vector containing a promoter operably linked to a polynucleotide encoding Cas9. Any suitable promoter can be used, including but not limited to, the promoters described herein. In certain embodiments, the promoter is a ubiquitin-1 promoter (e.g., prUbi-10). DNA construct (e.g., the expression cassettes and vectors described herein) can be introduced directly to plant tissue, for example, using ballistic methods, such as DNA particle bombardment.

Each of the crRNA, and the tracRNA, nuclease can be introduced separately or together as part of one expression vector into the cell of interest (e.g., a maize plant cell). In certain embodiments, the crRNA and the tracRNA are fused together to create a guide ribonucleic acid (gRNA). In some embodiments, the gRNA includes, from 5' to 3', a crNA linked to a tracRNA. In certain embodiments the crRNA, tracRNA, and nuclease (e.g., Cas9) are introduced together as nucleic acid cassettes included in one expression vector. Each component of the subject method is discussed in detail below.

Guide RNA

In one aspect provided, provided herein is a guide RNA (gRNA) comprising a CRISPR ribonucleic acid (crRNA) and a transacting RNA (tracRNA).

The crRNA of the subject gRNA comprises a nucleotide sequence that is complementary to a sequence in a PYR/PYL mutation target site and includes a sequence that is substantially identical to SEQ ID NOS: 363, 364, 365, 366, 367 or 369. In certain embodiments, the crRNA has a sequence that is substantially identical to SEQ ID NOS: 363, 364, 365, 366, 367 or 369. The subject crRNAs provided herein are particularly useful for creating mutations at a PYR/PYL mutation target site that includes a nucleic acid encoding for an amino acid corresponding to V89 (SEQ ID NOS: 363, 364, 365, 366, 367) and E149 (SEQ ID NO:369) of PYL-E. As used herein, a "PYR/PYL mutation target site" refers to a region of a polynucleotide encoding for a PYR/PYL receptor that includes the site where a mutation is introduced by the subject method. The crRNA interacts with the PYR/PYL mutation target site in a sequence-specific manner by hybridization to a sequence in the PYR/PYL mutation target site (e.g., the complementary strand of the PYR/PYL mutation target site) and, together with the tracRNA of the gRNA, recruits Cas9 endonuclease to the PYR/PYL mutation target site. Cas9 endonuclease recruited by the gRNA to the PYR/PYL mutation target site introduces a double strand break in the PYR/PYL mutation target site. Any of the mutations described herein can be made in any wildtype PYR/PYL polypeptide. Analogous amino acid substitutions can be made, for example, in PYR/PYL receptors other than PYL-E by aligning the PYR/PYL receptor polypeptide sequence to be mutated with the PYL-E receptor polypeptide sequence. Analogous amino acid positions in PYR/PYL recetpros are shown in FIGS. 2 and 3.

In some embodiments, the PYR/PYL mutation target site has the sequence of SEQ ID NO: 362, which includes a nucleic acid encoding for V89 of PYL-E. In some embodiments, the PYR/PYL mutation target site has the sequence of SEQ ID NO:368, which includes a nucleic acid encoding for E149 of PYL-E.

In some embodiments, a crRNA has a length of 10 nucleotides (nt) to 100 nucleotides (nt). In some embodiments, the crRNA has a length of 15, 16, 17, 18, 19, 20, 21, 22, 23, 24, 25, 26, 27, 28, 29, 30 nt and includes a sequence that is substantially identical to SEQ ID NOS: 362, 363, 364, 365, 366 or 368. In some embodiments, the crRNA has a length of at least 17 nt. In some embodiments, the crRNA has a length of 17 nt to 18 nt, 17 nt to 19 nt, 17 nt to 20 nt, 17 nt to 21 nt, 17 nt to 22 nt, 17 nt to 23 nt, 17 nt to 24 nt, 17 nt to 25 nt, 17 nt to 30 nt, 17 nt to 35 nt, 17 nt to 40 nt, 17 nt to 45 nt, 17 nt to 50 nt, 17 nt to 55 nt, 17 nt to 60 nt, 17 nt to 65 nt, 17 nt to 70 nt, 17 nt to 75 nt, 17 nt to 80 nt, 17 nt to 85 nt, 17 nt to 90 nt, 17 nt to 95 nt, or 17 nt to 100 nt. In some embodiments, the crRNA has a length of 12 nt to 25 nt, 13 nt to 25 nt, 14 nt to 25 nt, 15 nt to 25 nt, 16 nt to 25 nt, 17 nt to 25 nt, 18 nt to 25 nt, 19 nt to 25 nt, 20 nt to 25 nt, 21 nt to 25 nt, or 22 nt to 25 nt.

In some embodiments, the crRNA is 17 nt in length, In some embodiments, the crRNA is 18 nt in length. In some embodiments, the crRNA is 19 nt in length. In some embodiments, the crRNA is 20 nt in length. In some embodiments, the crRNA is 21 nt in length. In some embodiments the crRNA is 22 nt in length. In some embodiments, the crRNA is 23 nt in length. In some embodiments, the crRNA is 24 nt in length. In some embodiments, the crRNA is 25 nt in length.

In some embodiments, the crRNA is at least 17 nt in length, In some embodiments, the crRNA is at least 18 nt in length. In some embodiments, the crRNA is at least 19 nt in length. In some embodiments, the crRNA is at least 20 nt in length. In some embodiments, the crRNA is at least 21 nt in length. In some embodiments the crRNA is at least 22 nt in length. In some embodiments, the crRNA is at least 23 nt in length. In some embodiments, the crRNA is at least 24 nt in length. In some embodiments, the crRNA is at least 25 nt in length.

In some embodiments, the guideRNA (gRNA) includes a transacting RNA (tracRNA). Transacting RNA of the subject guideRNA interacts with the crRNA to recruit a nuclease to the site of a PYR/PYL mutation target site. Upon its recruitment to the PYR/PYL mutation target site, the nuclease creates a double strand break (DSB) in the PYR/PYL mutation target site. Any suitable tracRNA capable of recruiting a Cas9 to a PYR/PYL mutation target site can be used with the subject gRNA. In some embodiments, the tracRNA is encoded by a nucleotide having a sequence that is substantially identical to SEQ ID NO: 370. In certain embodiments of the subject method, the tracRNA and the crRNA are introduced into the plant cells separately (e.g., on different expression vectors). In some embodiments, the tracRNA is linked to the crRNA and introduced into the plant cell as a guideRNA (gRNA).

In another aspect, provided herein is a nucleic acid that includes a polynucleotide encoding any of the subject gRNAs described herein.

In another aspect, provided herein is an expression cassette that includes an RNA polymerase promoter operably linked to any of the subject gRNAs described herein. Any suitable RNA polymerase promoter capable of driving transcription of the nucleic acid encoding the subject gRNA can be used. In some embodiments, the promoter is an inducible promoter, including, but not limited, to any of the inducible promoters described herein. In other embodiments, the promoter is a constitutive promoter, including, but not limited to any of the constitutive promoters described herein. In yet other embodiments, the promoter is a tissue-specific promoter, including, but not limited to, any of the tissue-specific promoters described herein. In certain embodiments, the RNA polymerase promoter is an RNA polymerase III (polIII) promoter. In particular embodiments, the polIII promoter is a U3 promoter or a U6 promoter. In certain embodiment, the expression cassette has the sequence of any one of SEQ ID NOS; 371-373.

Expression Vectors Including gRNA and Cas9 Nuclease

In another aspect, provided herein is an expression vector that includes one or more of the guide RNA (gRNA) expression cassettes provided herein and an expression cassette including a promoter operably linked to a polynucleotide encoding a CRISPR-associated endonuclease 9 (Cas9). In some embodiments, the promoter operably linked to the Cas9 is a ubiquitin-1 promoter (prUbi-10). In some embodiments, the expression includes an expression cassette containing a polynucleotide encoding a gRNA having a crRNA that is substantially identical to SEQ ID NOS: 363, 364, 365, 366, 367 (see, e.g., FIG. 5). In some embodiments, the expression vector includes an expression cassette containing a polynucleotide encoding a gRNA having a crRNA that is substantially identical to SEQ ID NOS: 369 (see, e.g., FIG. 6). In some embodiments, the expression vector includes a first expression cassette containing a polynucleotide encoding a gRNA having a crRNA that is substantially identical to SEQ ID NOS: 363, 364, 365, 366, 367; a second expression cassette containing a polynucleotide encoding a gRNA having a crRNA that is substantially identical to SEQ ID NO: 369; and a third expression cassette including a promoter operably linked to a polynucleotide encoding a CRISPR-associated endonuclease 9 (Cas9) (see, e.g., FIG. 7).

Methods of Producing PYR/PYL Variant Plants Using RNA Directed Genome Modification Expression vectors disclosed herein are useful, for example, for introducing a mutation in a plant in situ at a genomic PYR/PYL mutation target site. Thus, in another aspect, provided herein is a method for of producing a plant having a mutation at a genomic PYR/PYL mutation target site. In some embodiments, the method includes introducing into plant cells an expression vector encoding for a gRNA and Cas9 as disclosed herein and at least one repair nucleic acid comprising the mutation of interest. According to the subject method, the crRNA and tracRNA directs the nuclease to the PYR/PYL mutation target site in a plant cell genome. Upon its recruitment, the nuclease (e.g., Cas9) creates a double strand break at the PYR/PYL mutation target site. The double strand break at the PYR/PYL mutation target site facilitates homologous recombination of the repair nucleic acid containing the mutation of interest with a region of the plant cell genome that includes the PYR/PYL mutation target site, thereby introducing the mutation at the PYR/PYL mutation target site. In certain embodiments, the repair nucleic acid has a sequence that is substantially identical to any one of the sequence of SEQ ID NOS:374 to 378. In other embodiments, the repair nucleic acid has a sequence that is complementary to a sequence that is substantially identical to any one of the sequences of SEQ ID NOS:374 to 386. In specific embodiments, the repair nucleic acid has a sequence that is substantially identical to SEQ ID NO:376. In other embodiments, the repair nucleic acid has a sequence that is complementary to a sequence that is substantially identical to SEQ ID NO:376. In another embodiment, the repair nucleic acid has a sequence that is substantially identical to SEQ ID NO:378. In other embodiments, the repair nucleic acid has a sequence that is complementary to a sequence that is substantially identical to SEQ ID NO:378. In yet another embodiment of the method, two repair nucleic acids are introduced, where the repair nucleic acids have sequences that are substantially identical to SEQ ID NO:376 and SEQ ID NO:378. In another embodiment of the method, two repair nucleic acids are introduced, where the repair nucleic acids have sequences are complementary to sequences that are substantially identical to SEQ ID NO:376 and SEQ ID NO:378.

In certain embodiments, the method further includes the step of selecting plant cells having the mutation. Selection for mutation can be performed by any useful technique known in the art, including, but not limited PCR amplification followed by sequencing, capillary electrophoresis and Nuclease Serveyer assay. In some embodiments, the method is for the production of a maize plant.

In yet another aspect, provided herein is a kit for producing a plant having a mutation in a PYR/PYL nucleic acid as described herein. In some embodiments, the kit includes any one of the subject expression vectors disclosed herein and at least one repair nucleic acid, wherein the repair nucleic acid comprises a PYL-E mutation and is capable of introducing the PYL-E mutation in situ in a plant cell genome by homologous recombination upon a Cas9 cleavage event. In certain embodiments, the kit includes a repair nucleic acid that has a sequence that is substantially identical to SEQ ID NOS:374 to 386.

EXAMPLES

The following examples are offered to illustrate, but not to limit the claimed invention.

The affinity of a receptor for a target ligand is typically determined by non-covalent interactions between ligand-binding residues and the ligand. Mutations in such residues can have negative, positive or neutral effects on the strength of the receptor—ligand interaction. The affinity of a receptor-ligand interaction is intrinsically correlated with the concentration of ligand required to elicit biological effects, with high affinity ligands requiring lower concentrations relative to low affinity ligands. A mutant receptor with increased affinity for a ligand can in some cases elicit greater biological effect relative to a wild type receptor, when both are activated under identical conditions by the same concentration of activating ligand. Thus, mutations that make a receptor hypersensitive to a ligand can be useful for engineering organisms that elicit stronger responses to the ligand relative to wild type. Furthermore, ABA hypersensitive plants possess enhanced ABA responses and improved drought tolerance (Wang, Y., et al. *Plant J.* 43, 413-424 (2005)). Based on these considerations, we set out to systematically establish specific ABA receptor mutations that increase ABA responsiveness. This was done by testing a collection of PYR1 variants with all possible single amino acid substitution mutations in ligand binding residues. Thus we conducted site-saturated mutagenesis of ABA-contacting residues, which we define as those that are within 5A or ABA or ABA-contacting water residues in available X-ray coordinates. This collection of mutants was constructed previously, as described in PCT Application No. PCT/US2012/043121 and Mosquna et al., *Proc Natl Acad Sci USA* 108: 20838-20843 (2011). This collection of mutants was made by mutagenizing a previously described pBD GAL-PYR1 template (Park, S.-Y., et al. *Science* 324, 1068-1071 (2011)). In response to ABA, this particular plasmid encodes a fusion protein that binds to a co-expressed GAL4 activation domain-HAB1 fusion protein, encoded by the plasmid pACT-HAB1. This binding reconstitutes a functional GAL4 transcriptional activator and subsequent transcription of a β-galactosidase reporter gene, which in turn enables colorimetric based detection of agonist promoted receptor-PP2C interaction when lysed cells are exposed to the substrate X-gal. The mutant clones were individually transformed into *S. cerevisiae* strain Y190 containing pACT-HAB1. Yeast transformants were selected for the presence of plasmids on synthetic dextrose (SD) agar plates lacking Leu and Trp (SD-LT) and examined for PP2C interactions by using X-gal staining to monitor β-gal reporter gene expression levels. Individual clones were arrayed into 96 well plates and then spotted onto SD-LT lawn (i.e. one-well) plates containing 0, 0.5 or 5.0 μM (+)-ABA. Each assay plate contained 95 mutant clones and one wild type PYR1 positive control clone. The spotted cells were cultured at 30° C. for 48 hours after which they were lysed by chloroform and stained with an X-gal solution, as previously described (Park, S.-Y., et al. (2009) *Science* 324, 1068-1071). Positive were defined as those mutants that displayed staining on 0.5 μM (+)-ABA but no staining on plates lacking (+)-ABA. After this initial screening exercise, all positives clones were retested on plates containing 0.0.25, 0.5 and 1 (+)-ABA and stained for galactosidase activity as described above. Mutant clones showing detectable staining on 0.5 μM (+)-ABA or lower were scored as hypersensitive mutants. FIG. 1 depicts results of PYR1 mutant-HAB1 interactions as assayed in a yeast two-hybrid assay under different ABA concentrations, with darker spots indicating increased interaction. This data is also summarized below:

| Mutant | SEQ ID NO: | Residue | WT AA | Mutant | Minimal conc. For ABA response (μM) |
|---|---|---|---|---|---|
| WT | 1 | | | | 1 |
| F61L | 124 | 61 | F | L | 0.25 |
| F61M | 125 | 61 | F | M | 0.25 |
| V81I | 126 | 81 | V | I | 0.25 |
| V81Y | 127 | 81 | V | Y | 0.25 |
| I110C | 128 | 110 | I | C | 0.25 |
| I110S | 129 | 110 | I | S | 0.5 |
| E141C | 130 | 141 | E | C | 0.5 |
| E141I | 131 | 141 | E | I | 0.25 |
| E141L | 132 | 141 | E | L | 0.25 |
| E141M | 133 | 141 | E | M | 0.25 |
| E141N | 134 | 141 | E | N | 0.5 |
| E141T | 135 | 141 | E | T | 0.5 |
| E141V | 136 | 141 | E | V | 0.5 |
| E141W | 137 | 141 | E | W | 0.5 |
| E141Y | 138 | 141 | E | Y | 0.25 |
| A160C | 139 | 160 | A | C | 0.25 |
| A160I | 140 | 160 | A | I | 0.25 |
| A160V | 141 | 160 | A | V | 0.25 |

Highly Hypersensitive ABA Receptors Constructed by Combinatorial Mutagenesis

Additive or synergistic interactions between the single hypersensitive mutations identified can increase a receptor's sensitivity to ABA. To identify potentially beneficial combinations, we used combinatorial mutagenesis to construct receptors that contain combinations of subsets of the best single mutants identified and then screened these to identify receptors with increased sensitivity. Mutagenic primers complementary to the appropriate regions of PYR1 coding sequence were designed to enable the following mutations to be incorporated into a PYR1 template DNA: F61L, F61M, V81I, V81Y, I110C, I110S, E141I, E141L, E141M, E141Y, A160C, A160I, A160V. Equimolar concentrations of these primers were combined with a mixture of wild type primers for each target site (4 mol percent relative to the mutant primer pool) and the primer mix utilized with the Quick-Change Lightning Multi Site-Directed PCR Mutagenesis kit (Agilent, USA) using the pBD-PYR1 template DNA. The use of wild type primers in the reaction mixtures enabled, in principle, all double, triple, quadruple and pentuple mutant combinations to be synthesized in the mutagenesis reaction. The reaction products were transformed into competent *E. coli* cells to yield a pool of ~10,000 clones, which was then used to prepare plasmid DNA for the mutant library. The pool of mutant plasmids was subsequently introduced into the previously described pAD-HAB1 MAV99 reporter strain (Peterson, F. C., et al. (2010) *Nature Structural & Molecular Biology* 17, 1109-1113). In this reporter strain, a GAL4 promoter drives expression of a URA3 reporter gene in a genetic background where the endogenous URA3 gene is disrupted, which enables positive selections using uracil deficient media. Thus, mutant clones that encode receptors that can interact with HAB1 can be positively selected using this system. The transformed yeast cells containing the mutant receptor library were next plated onto growth medium lacking uracil and containing 50 nM ABA, a concentration of ABA that is too low to enable growth of control strains. 26 colonies with uracil-independent growth were identified, which were isolated and re-tested on medium lacking ABA to eliminate cones enabling ligand-independent (i.e. constitutive) interactions of receptor with HAB1. Plasmids from yeast cells containing non-constitutive receptors were isolated and sequenced, which revealed that the following 4 highly hypersensitive combination mutants had been isolated:
PYR1F61L, A160C,
PYR1F61M, A160V,
PYR1F61M, I110S, A160V,
PYR1F61L, V81I, I110C, A160V.

Figure 4:
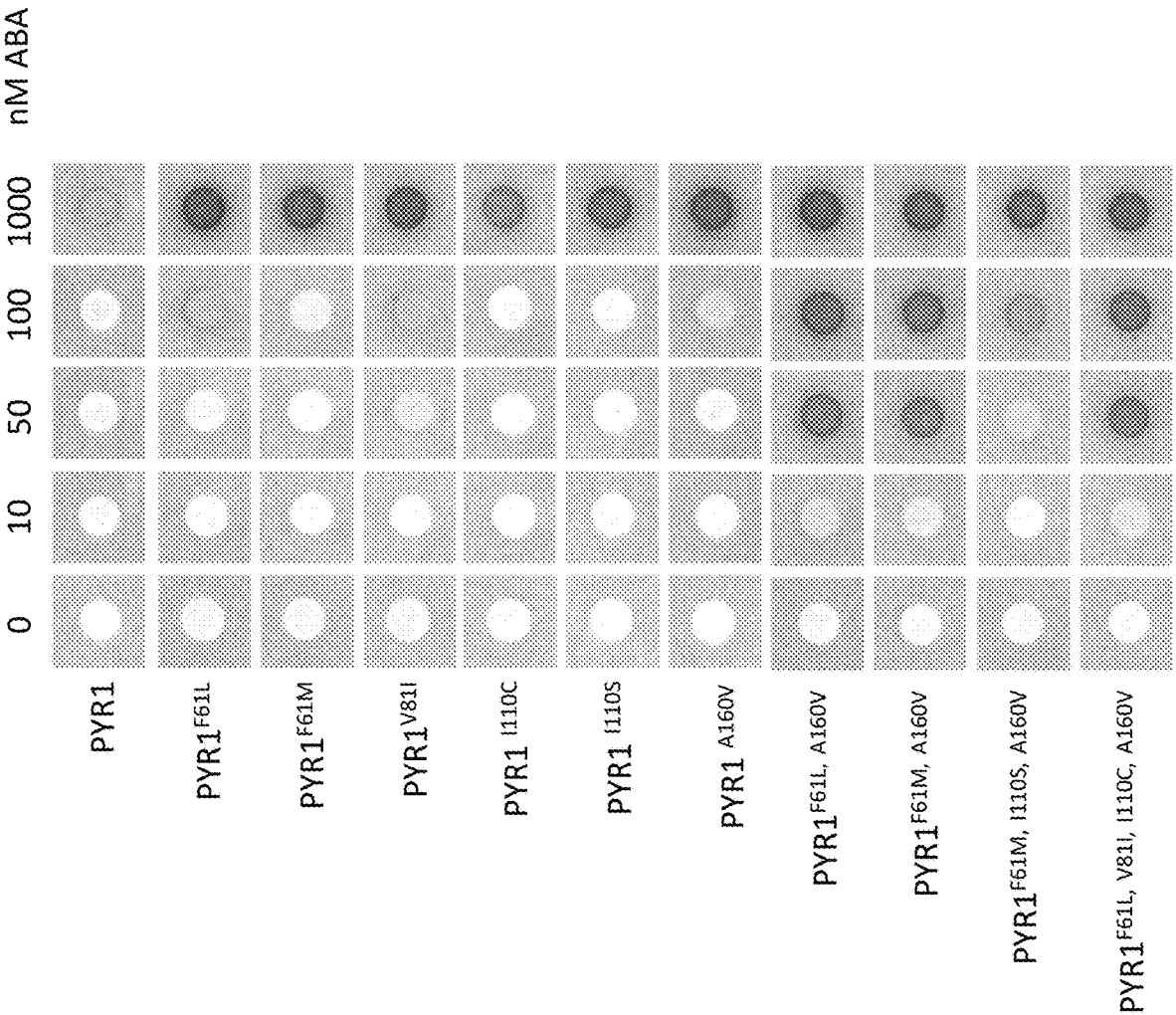
FIG. 4 provides signal in a yeast two-hybrid assay and includes multiple mutations within PYR1.

The plasmids for each of these mutants and their corresponding single mutations were transformed into the previously described yeast reporter strain, Y190 pAD-HAB1 (Park, S.-Y., et al. (2009) *Science* 324, 1068-1071). The transformed yeast cells were grown on selective media containing a range of ABA concentrations and cells lysed and stained to reveal β-galactosidase activity, as shown in FIG. 4.

Increased Affinity of a Mutant Hypersensitive Receptor

The ligand sensitivity of PYR1 and HAB1 yeast two hybrid strains generally correlates with receptor affinity. To examine if this was the case for the hypersensitive mutations identified by our functional screens, we conducted isothermal titration calorimetry (ITC) to measure the heat produced by a mutant receptor-ABA binding reaction and infer the ligand binding dissociation constant (Kd). The affinity of wild type PYR1 has been previously measured using ITC and estimated to be 97±36 µM (Dupeux et al. 2010). The PYR1-A160V mutant receptor was expressed in *E. coli* BL21(DE3) as a fusion to the small ubiquitin like protein SUMO, using the vector pSUMO (LifeSensors, USA), which improves the solubility of proteins in *E. coli* and contains an NH2-terminal hexa-histidine tag that facilitates purification using immobilized metal affinity chromatography (IMAC). PYR1 A160V was cloned into pSUMO by using PCR product generated from a pBD-PYR1(A160V) yeast two hybrid construct as template, and sequence validated. A short flexible linker and tobacco etch virus (TEV) protease cleavage site (sequence NH2-GGGSQFGSGGGGSGSENLYFQS-COOH; SEQ ID NO:411) was incorporated in between the SUMO tag and the receptor to enable cleavage of the recombinant protein by TEV protease, which yields PYR1(A160V) plus an NH2-terminal QS appendage. Recombinant SUMO-TEV-PYR1 (A160V) protein was produced in *E. coli* and purified by immobilized metal affinity chromatography as previously described (Okamoto et al., *Proceedings of the National Academy of Sciences of the United States of America* 110, no. 29 (2013): 12132-12137). The purified fusion protein was digested with recombinant TEV protease according to established protocols, and the cleaved protein subsequently separated from both the SUMO tag and uncleaved protein by passing the cleavage reaction over an IMAC column, which does not retain the cleaved PYR1(A160V) product. The cleaved protein was purified by gel filtration using a Superdex column (GE Healthcare, USA) and concentrated by centrifugal concentration using Amicon filters (EMD, USA), as previously described (Dupeux et al, *The EMBO Journal* 30, no. 20 (2011): 4171-4184). The concentrated protein was utilized for ITC experiments, using a TA instruments Nano ITC Low Volume instrument, repeatedly injecting 2.5 µL of a 600 µM (+)-ABA solution into a reaction cell containing 60 µM PYR1(A160V) every 300 seconds for 200 minutes. Both the ABA and protein were dissolved in a buffer containing PBS, 1 mM 2-mercaptoethanol and 0.012% DMSO. The thermograms generated were processed using the instrument's software to a normalized fit single binding site model, which yielded a Kd of 1.5 µM and a binding stoichiometry of 1.068. These data demonstrate that the A160V mutation possesses increased ABA affinity relative to wild type PYR1, consistent with the increased sensitivity indicated by yeast two hybrid assays.

Targeted Genome Modification

Non-transgenic plants harboring induced mutations in specific genes can be obtained in multiple ways. Chemical mutagenesis of an organism can be used to create random genome-wide mutations and populations of mutagenized individuals can be scanned using high-throughput mutation detection methods to identify individuals harboring specific mutations in genes of interest. For example, TILLING (Targeting Induced Local Lesions in Genomes) enables an investigator to identify non-naturally occurring induced-mutations in a gene by using PCR to amplify a gene of interest from 1000s of mutagenized individuals and use hetero-duplex specific nucleases, such as celery nuclease CEL1, to identify plants harboring a mutation in the PCR amplified region (McCallum, C. M., et al. (2000). *Nat. Biotechnol.* 18, 455-457). Many technologies are available for polymorphism identification in addition to endonucleases, including direct sequencing of PCR products obtained from mutagenized individuals.

To identify maize plants containing ABA receptors with increased sensitivity an EMS mutagenized population is created and from this population all ABA receptor genes are PCR amplified from 1000s of mutagenized plants. The amplified products are scanned for polymorphisms using TILLING methodology and polymorphic fragments identified are sequenced to define the specific mutations present. From this, individuals harboring mutations corresponding to the polymorphisms described in this application are identified.

The most likely mutants to be obtained using this strategy are those that can be encoded by a single nucleotide substitution, which can be established by examining the codon table. For example, receptors with mutations homologous to F61L or F61M in PYR1 can be obtained in receptor homologs by screening for different single nucleotide substitutions depending on the gene sequence, such as UUU→CUU, or UUC→CUC. The same is true for A160V (GCN→GUN), V81I (GUU→AUU, GUC→AUC, GUA→AUA), V81Y (GUU→UUU, GUC→UUC). In principle, any single mutation can be isolated by chemical mutagenesis TILLING, but in practice the subset of changes that can arise by a single nucleotide substitution are most likely to be obtained. The examples provided above are representative, not exhaustive, and other single nucleotide substitutions enabling desired mutations, such as E141V and I110S, are also possible.

Other mutation induction systems can be used to target mutations in specific genes, such as genome editing methods, which have the advantages of increasing the frequency of single and multiple mutations at a defined target site (Lozano-Juste, J., and Cutler, S. R. (2014) *Trends in Plant Science* 19, 284-287). The sequence-specific introduction of a double stranded DNA break (DSB) in a genome leads to the recruitment of DNA repair factors at the breakage site, which then repair lesion by either the error-prone non-homologous end joining (NHEJ) or homologous recombination (HR) pathways. NHEJ repairs the breaks, but is imprecise and often creates diverse mutations at and around the DSB. In cells in which the HR machinery repairs the DSB, sequences with homology flanking the DSB, including exogenously supplied sequences, can be incorporated at the region of the DSB. DSBs can therefore be leveraged by geneticists to increase the frequency of mutations at defined sites, however intrinsic differences between the relative roles of HR and NHEJ can affect the mutation types at a targets locus. A number of technologies have been developed to create DSBs at specific sites including synthetic zinc finger nucleases (ZFNs), transcription activator-like endonucleases (TALENs) and most recently the clustered regularly interspaced short palindromic repeats (CRISPR)/CRISPR-associated protein 9 (Cas9) system. This system is based on a bacterial immune system against invading bacteriophages in which a complex of 2 small RNAs, the CRISPR-RNA (crRNA) and the trans-activating crRNA (tracrRNA) directs a nuclease (Cas9) to a specific DNA sequence complementary to the crRNA. Using any of these systems, an investigator can create DSBs at pre-determined sites in cells expressing the genome editing constructs. In order for homologous recombination to occur, a DNA cassette homologous to the targeted site must be provided, preferably at a high concentration so that HR is favored or NHEJ. Multiple strategies are conceivable for realizing this, including template delivery using *agrobacterium* mediated transformation or particle bombardment of DNA templates, and one recently described method uses a modified viral genome to provide the double stranded DNA template. For example, Baltes et al. 2014 (Baltes, N. J., et al. (2014) *Plant Cell* 26, 151-163) recently demonstrated that an engineered geminivirus that was introduced into plant cells using *Agrobacterium* mediated transformation could be engineered to produce DNA recombination templates in cells where a ZFN was co-expressed.

In some aspects, once DSBs have been created using any number of technologies, such sites can be exploited to facilitate isolation of targeted genetic changes by either homologous recombination of nucleotide substitutions, deletions or insertions. For example, ABA receptor genes can be targeted using genome editing technologies and progeny plants of the mutagenized plants be screened using the methods outlined above to identify mutations at sites that increase ABA sensitivity. Delivery of genome editing constructs into organisms can involve both unstable transient expression constructs or stable integration of constructs into genomes delivered by *Agrobacterium* mediated transformation. In the latter case, stable transgenic plants can be used to express genome-editing constructs in plants to increase mutation frequencies at the target site. Once the desired mutants are isolated through polymorphism scans (analogous to those used in TILLING), individuals can be back crossed wild type lines to segregate away transgenic insertion events.

Conceptually, these methods are analogous to TILLING and the methods for identifying defined mutations would be similar, however because of the targeted nature of these methods, the frequency of mutations at defined sites will be higher and mutations involving changes of more than a single base pair can be identified more readily.

Targeted Amino Acid Modification of Maize ABA Receptors Mediated by CRISPR-Cas9

1. Maize ABA Receptor (ZmPYL) Target Gene Modification

Figure 5:
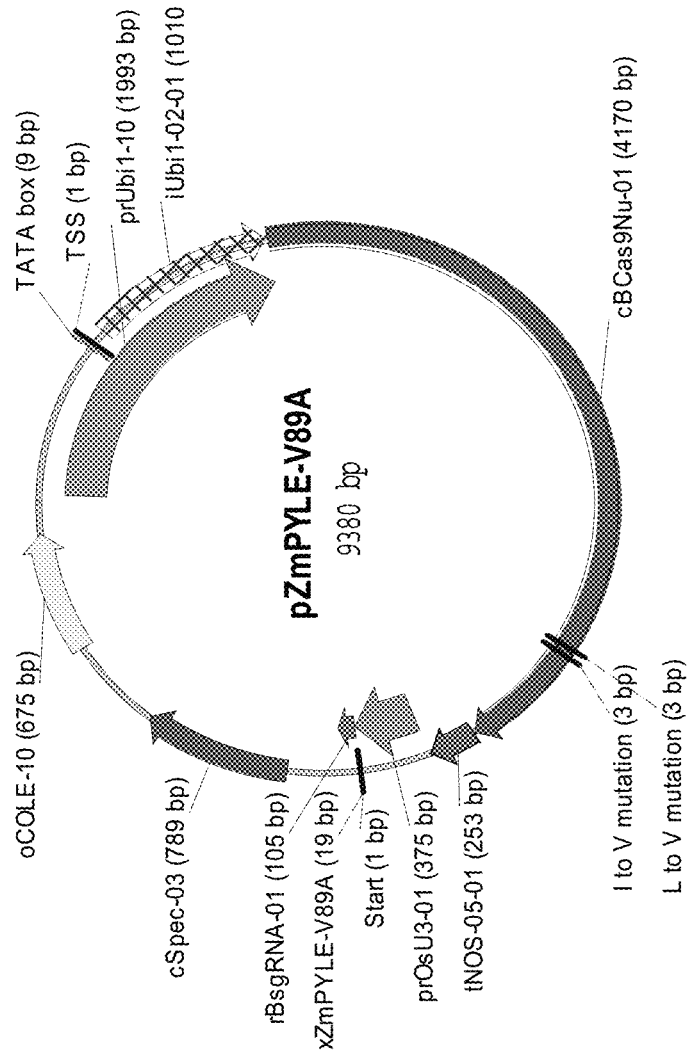
FIG. 5 depicts a biolistic transformation vector pZmPYLE-V89A carrying expression cassettes for maize-optimized Cas9 and ZmPYLE-V89A gRNA to mediate cleavage at the ZmPYL-E target sequence (5'-CGCGA CGTCA ACGTC AAGAC-3' (SEQ ID NO:362))

In vivo modification of plant ABA receptors is described using maize ZmPYL genes as an example. Maize genome contains more than 10 ABA receptors (ZmPYL-A to ZmPYL-P) that share several highly conserved amino acids with AtPYL1. To obtain ABA hypersensitive mutations in the endogenous ZmPYL-E (GRMZM2G165567) gene, two amino acids (V89 and E149) are chosen as targets for sequence-specific mutagenesis into desired mutant amino acids, alanine and leucine (V89A and E149L), respectively, using homology-directed gene repair mediated by sequence-specific nucleases and donor DNA template. Currently, there are several technology platforms for making sequence-specific nucleases, including for example zinc-finger nuclease, TALE nuclease, CRISPR-Cas9 and engineered meganuclease (Puchta and Fauser (2014), Synthetic nucleases for genome engineering in plants: prospects for a bright future. *Plant Journal* 78:727-741; Chen and Gao (2014) Targeted genome modification technologies and their applications in crop improvements. *Plant Cell Rep.* 33:575-583), any of which can be used to produce a plant comprising an in situ hypersensitive mutation in a genomic coding sequence PYR/PYL polypeptide as described herein.

The following examples describe the use of CRISPR-Cas9 system for making targeted gene modification in endogenous ZmPYL-E gene. CRISPR-Cas9-mediated gene modification requires these components: Cas9 nuclease, crRNA (CRISPR RNA) recognizing the mutagenesis target, tracRNA (transactivating RNA) and repair donor DNA template molecule. For easiness of use, crRNA and tracRNA are fused and delivered as a single guide RNA molecule (gRNA or sgRNA) [Sander and Joung (2014) CRISPR-Cas systems for editing, regulating and targeting genomes. 32:347-355].

2. Optimization of Cas9 and its Expression in Maize Cells

In order to achieve good expression in maize cells, Type II Cas9 gene from *Streptococcus pyogenes* SF370 is optimized with maize-preferred codons. Nuclear localization signal is also incorporated into the C-terminus of Cas9 to improve its targeting to nucleus. Below is the optimized Cas9 sequence (cBCas9Nu-01, aka, cCas9-01). To express Cas9 in maize cells, the maize-optimized Cas9 gene (cBCas9Nu-01) is placed under the control of maize ubiquitin-1 promoter (prUbi1-10) and is followed by a terminator sequences (tNOS) (FIG. 5).

3. gRNA Design and Expression 3.1 gRNAs for Mediating V89A Modification: Structure and its Expression For targeted V89A modification, crRNAs of at least 17 nucleotides (nt) long are designed against the maize ZmPYL-E genomic target sequence (5'-CGCGA CGTCA ACGTC AAGAC-3') (SEQ ID NO:362) preceding the 5'-CGG-3' PAM (protospacer adjacent motif) sequence for Cas9-mediated target recognition. For example, gRNAs of 17-nt (5'-GA CGUCA ACGUC AAGAC-3') (SEQ ID NO:363), 18-nt (5'-CGA CGUCA ACGUC AAGAC-3') (SEQ ID NO:364), 19-nt (5'-GCGA CGUCA ACGUC AAGAC-3') (SEQ ID NO:365), 20-nt (5'-CGCGA CGUCA ACGUC AAGAC-3') (SEQ ID NO:366) or 21-nt (5'-G CGCGA CGUCA ACGUC AAGAC-3') (SEQ ID NO:367) can be used to guide Cas9 cleavage of the ZmPYL-E target. crRNA is co-delivered with tracRNA and Cas9 protein or mRNA to mediate target site cleavage. Preferably, crRNA molecule is fused with tracRNA molecule covalently into a single guide RNA (gRNA). gRNAs can be synthesized chemically or produced by in vitro transcription. In vitro produced gRNAs can be used directly for physical delivery such as biolistic bombardment with Cas9 RNA or protein to mediate target cleavage and homology-directed target modification if repair donor oligonucleotide is co-delivered. More preferably, gRNA is produced in planta from DNA expression cassette comprising RNA polymerase III (PolIII) promoter such as plant U3 and U6 promoters such as rice U3 and U6 promoters (prOsU3 and prOsU6). For prOsU3, the transcription start begins with nucleotide A, whereas for prOsU6, the transcription starts with nucleotide G (Shan et al. (2013) *Nature Biotechnology* 31: 686-688; Xie and Yang (2013) *Molecular Plant* 6:1975-1983). For example, to produce gRNA targeting the endogenous ZmPYKL-E sequence (5'-CGCGA CGTCA ACGTC AAGAC-3') (SEQ ID NO:362), 19-nt DNA oligonucleotides (5'-GCGA CGTCA ACGTC AAGAC-3') (SEQ ID NO:365) or 21-nt oligonucleotides (5'-G CGCGA CGTCA ACGTC AAGAC-3') (SEQ ID NO:367) is fused to the DNA sequences encoding tracRNA scaffold ((5'-GTTTT AGAGC TAGAA ATAGC AAGTT AAAAT AAGGC TAGTC CGTTA TCAAC TTGAA AAAGT GGCAC CGAGT CGGTG C-3') (SEQ ID NO: 370) and PolIII termination sequences (5'-GTTTT AGAGC TAGAA ATAGC AAGTT AAAAT AAGGC TAGTC CGTTA TCAAC TTGAA AAAGT GGCAC CGAGT CGGTG CTTTT TTTTT-3'(SEQ ID NO:413), Mali et al. (2013) *Science* 339:823-826) and placed under the control of rice polymerase III promoter U3 (prOsU3) or U6 (prOsU6). Below is the sequence (SEQ ID NO:371) of the expression cassette comprising of prOsU3 and coding sequences for the gRNA comprising the 19-nt V89A crRNA (underlined) fused with tracRNA. This sequence is cloned into biolistic transformation vector along with the Cas9 expression cassette to form vector pZmPYLE-V89A (FIG. 5).

3.2 gRNA for Mediating E149L Modification: Structure and its Expression

Figure 6:
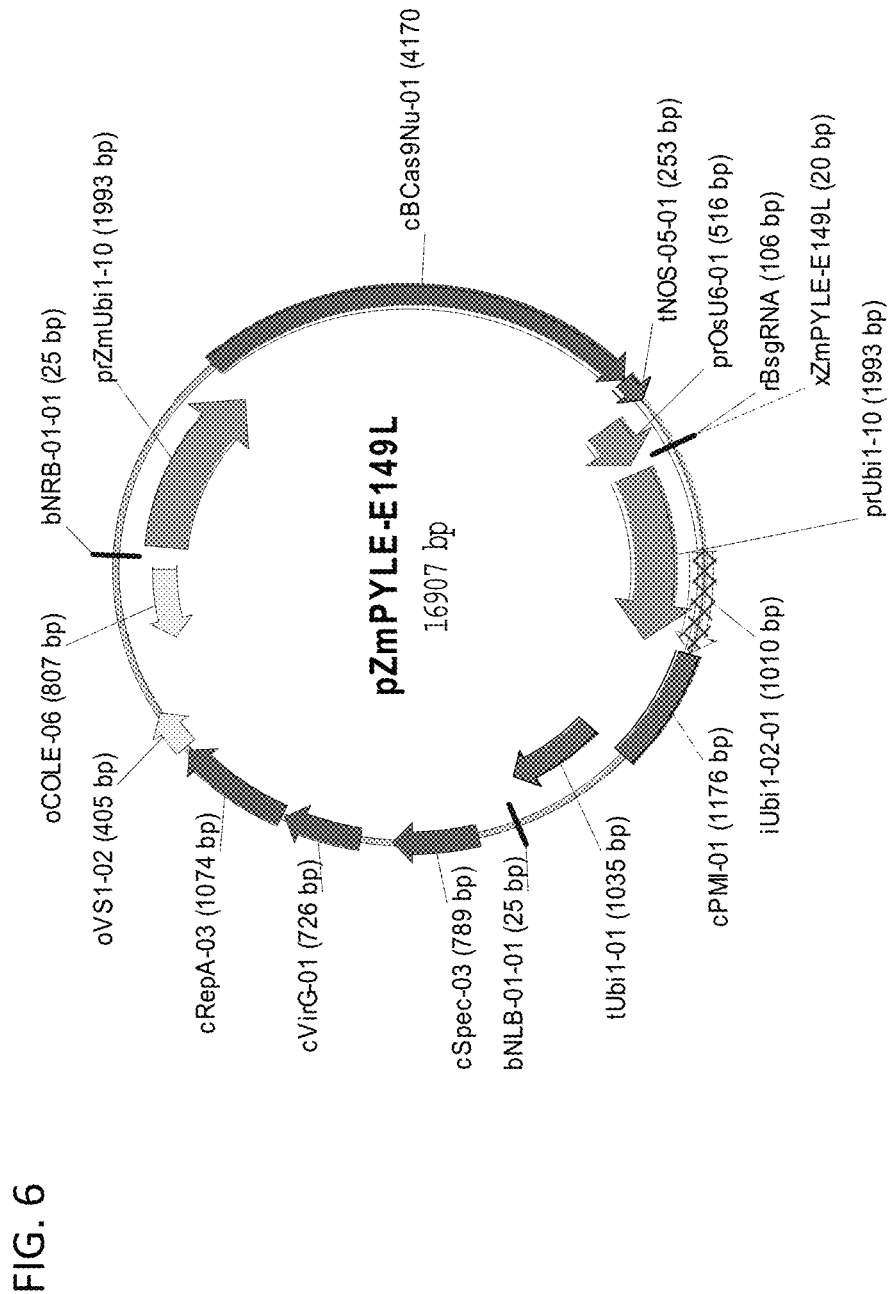
FIG. 6 provides a schematic map of binary vector pZmPYLE-E149L used for delivery with Agrobacterium-mediated transformation.
Figure 7:
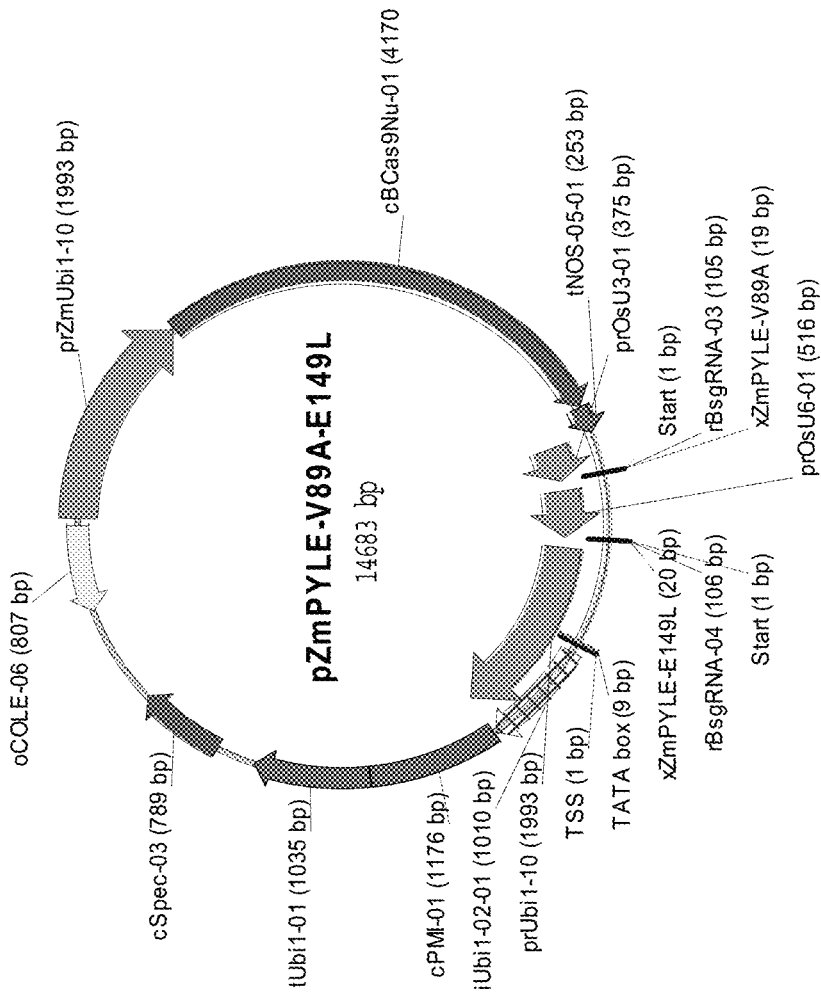
FIG. 7 provides a schematic map of plasmid vector pZmPYLE-V89A-E149L carrying expression cassettes for 2 different gRNAs and Cas9.

For targeted E149L modification of the maize ZmPYL-E, the two underlined bases in the maize genomic target sequence (5'-GCACC CTGGT GATCGAGTCG TTCGT GGTCG-3') (SEQ ID NO:368) needs to be converted into CT to form mutant sequence (5'-GCACC CTGGT GATCC TGTCG TTCGT GGTCG-3' (SEQ ID NO:412)). In order to achieve that, an expression cassette for a sequence coding for the 20-nt guide RNA (5'-CCTGG TGATC CTGTC GTTCG-3', xZmPYLE-E149L) (SEQ ID NO:369), tracRNA scaffold and PolIII termination sequences (5'-GTTTT AGAGC TAGAA ATAGC AAGTT AAAAT AAGGC TAGTC CGTTA TCAAC TTGAA AAAGT GGCAC CGAGT CGGTG CTTTT TTTTT-3' (SEQ ID NO:413), Mali et al. (2013) *Science* 339:823-826) was placed under the control of rice polymerase III promoter U6 (prOsU6) as shown in FIG. 6. prOsU6 promtoer initiates transcription after nucleotide G. In FIG. 6, the prOsU6-

(SEQ ID NO: 371)
5'-GGGAT CTTTA AACAT ACGAA CAGAT CACTT AAAGT TCTTC TGAAG CAACT TAAAG TTATC

AGGCA TGCAT GGATC TTGGA GGAAT CAGAT GTGCA GTCAG GGACC ATAGC ACAGG ACAGG CGTCT

TCTAC TGGTG CTACC AGCAA ATGCT GGAAG CCGGG AACAC TGGGT ACGTT GGAAA CCACG TGATG

TGGAG TAAGA TAAAC TGTAG GAGAA AAGCA TTTCG TAGTG GGCCA TGAAG CCTTT CAGGA CATGT

ATTGC AGTAT GGGCC GGCCC ATTAC GCAAT TGGAC GACAA CAAAG ACTAG TATTA GTACC ACCTC

GGCTA TCCAC ATAGA TCAAA GCTGG TTTAA AAGAG TTGTG CAGAT GATCC GTGGC A<u>GCGA CGTCA</u>

<u>ACGTC AAGAC</u> GTTTT AGAGC TAGAA ATAGC AAGTT AAAAT AAGGC TAGTC CGTTA TCAAC TTGAA

AAAGT GGCAC CGAGT CGGTG CTTTT TTTTT-3'

The sequence example below (SEQ ID NO:372) describes the expression cassette comprising of prOsU6 promoter and coding sequences for a gRNA comprising the 21-nt V89A crRNA (underlined) and tracRNA.

E149L gRNA expression cassette has the following sequences (SEQ ID NO:373) with the 20 bp targeting guide sequence (xZmPYLE-E149L or xZmPYLe, SEQ ID NO: 369) underlined.

(SEQ ID NO: 372)
5'-TTTGT GAAAG TTGAA TTACG GCATA GCCGA AGGAA TAACA GAATC GTTTC ACACT TTCGT

AACAA AGGTC TTCTT ATCAT GTTTC AGACG ATGGA GGCAA GGCTG ATCAA AGTGA TCAAG CACAT

AAACG CATTT TTTTA CCATG TTTCA CTCCA TAAGC GTCTG AGATT ATCAC AAGTC ACGTC TAGTA

GTTTG ATGGT ACACT AGTGA CAATC AGTTC GTGCA GACAG AGCTC ATACT TGACT ACTTG AGCGA

TTACA GGCGA AAGTG TGAAA CGCAT GTGAT GTGGG CTGGG AGGAG GAGAA TATAT ACTAA TGGGC

CGTAT CCTGA TTTGG GCTGC GTCGG AAGGT GCAGC CCACG CGCGC CGTAC CGCGC GGGTG GCGCT

GCTAC CCACT TTAGT CCGTT GGATG GGGAT CCGAT GGTTT GCGCG GTGGC GTTGC GGGGG ATGTT

TAGTA CCACA TCGGA AACCG AAAGA CGATG GAACC AGCTT ATAAA CCCGC GCGCT GTAGT CAGCT

T<u>GCGC GACGT CAACG TCAAG ACGTT</u> TTAGA GCTAG AAATA GCAAG TTAAA ATAAG GCTAG TCCGT

TATCA ACTTG AAAAA GTGGC ACCGA GTCGG TGCTTTT TTTTT-3'

(SEQ ID NO: 373)
```
5'-TTTGT GAAAG TTGAA TTACG GCATA GCCGA AGGAA TAACA GAATC GTTTC ACACT TTCGT

AACAA AGGTC TTCTT ATCAT GTTTC AGACG ATGGA GGCAA GGCTG ATCAA AGTGA TCAAG CACAT

AAACG CATTT TTTTA CCATG TTTCA CTCCA TAAGC GTCTG AGATT ATCAC AAGTC ACGTC TAGTA

GTTTG ATGGT ACACT AGTGA CAATC AGTTC GTGCA GACAG AGCTC ATACT TGACT ACTTG AGCGA

TTACA GGCGA AAGTG TGAAA CGCAT GTGAT GTGGG CTGGG AGGAG GAGAA TATAT ACTAA TGGGC

CGTAT CCTGA TTTGG GCTGC GTCGG AAGGT GCAGC CCACG CGCGC CGTAC CGCGC GGGTG GCGCT

GCTAC CCACT TTAGT CCGTT GGATG GGGAT CCGAT GGTTT GCGCG GTGGC GTTGC GGGGG ATGTT

TAGTA CCACA TCGGA AACCG AAAGA CGATG GAACC AGCTT ATAAA CCCGC GCGCT GTAGT CAGCT

TGCCT GGTGA TCGAG TCGTT CGGTT TTAGA GCTAG AAATA GCAAG TTAAA ATAAG GCTAG TCCGT

TATCA ACTTG AAAAA GTGGC ACCGA GTCGG TGCTT TTTTT TT-3'
```

Figure 8:
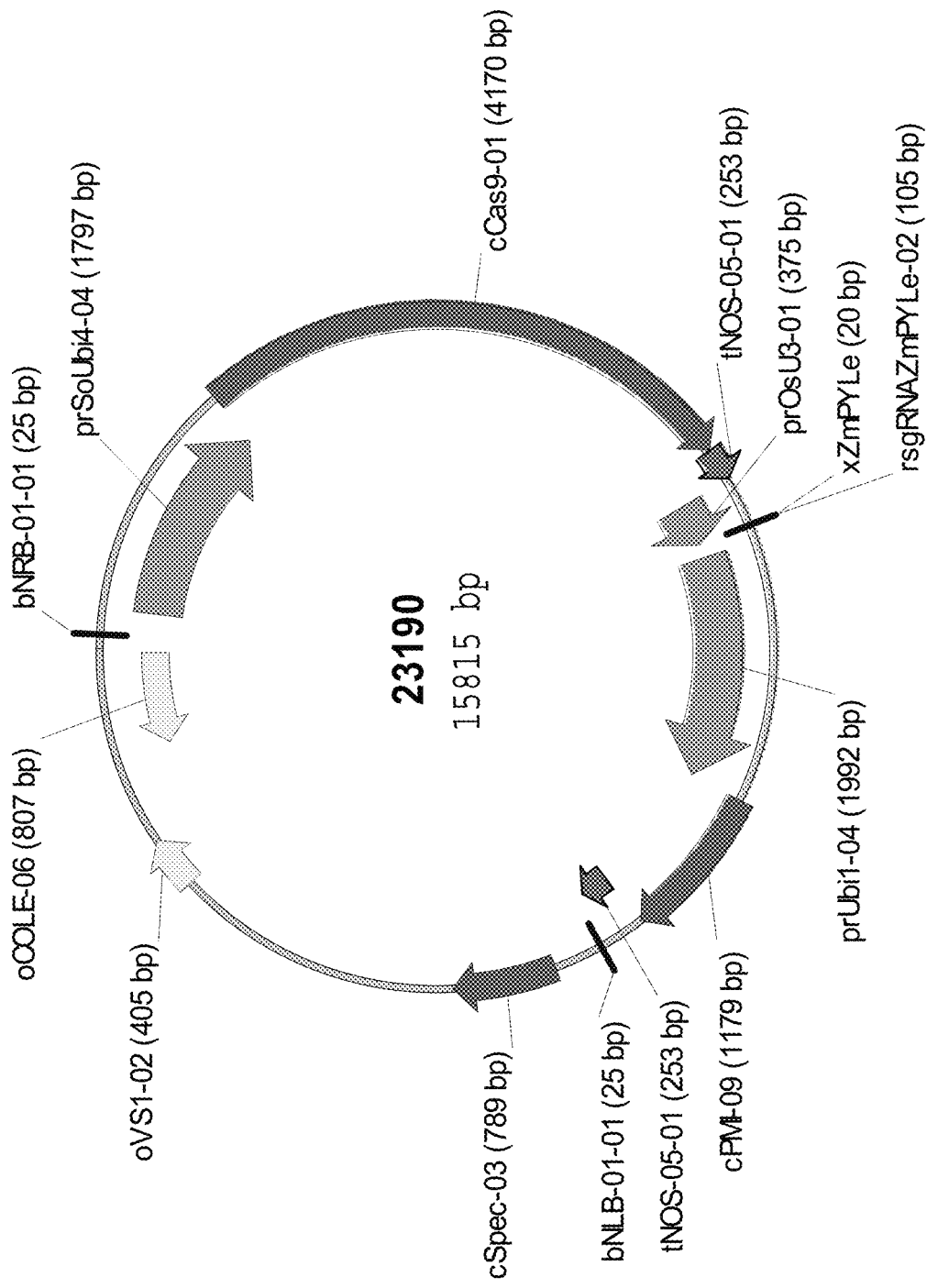
FIG. 8 provides a schematic map of binary plant transformation vector 23190 carrying expression cassettes for Cas9, gRNA and selectable marker gene PMI for mediating ZmPYL-E E149L mutagenesis.
Figure 9A:
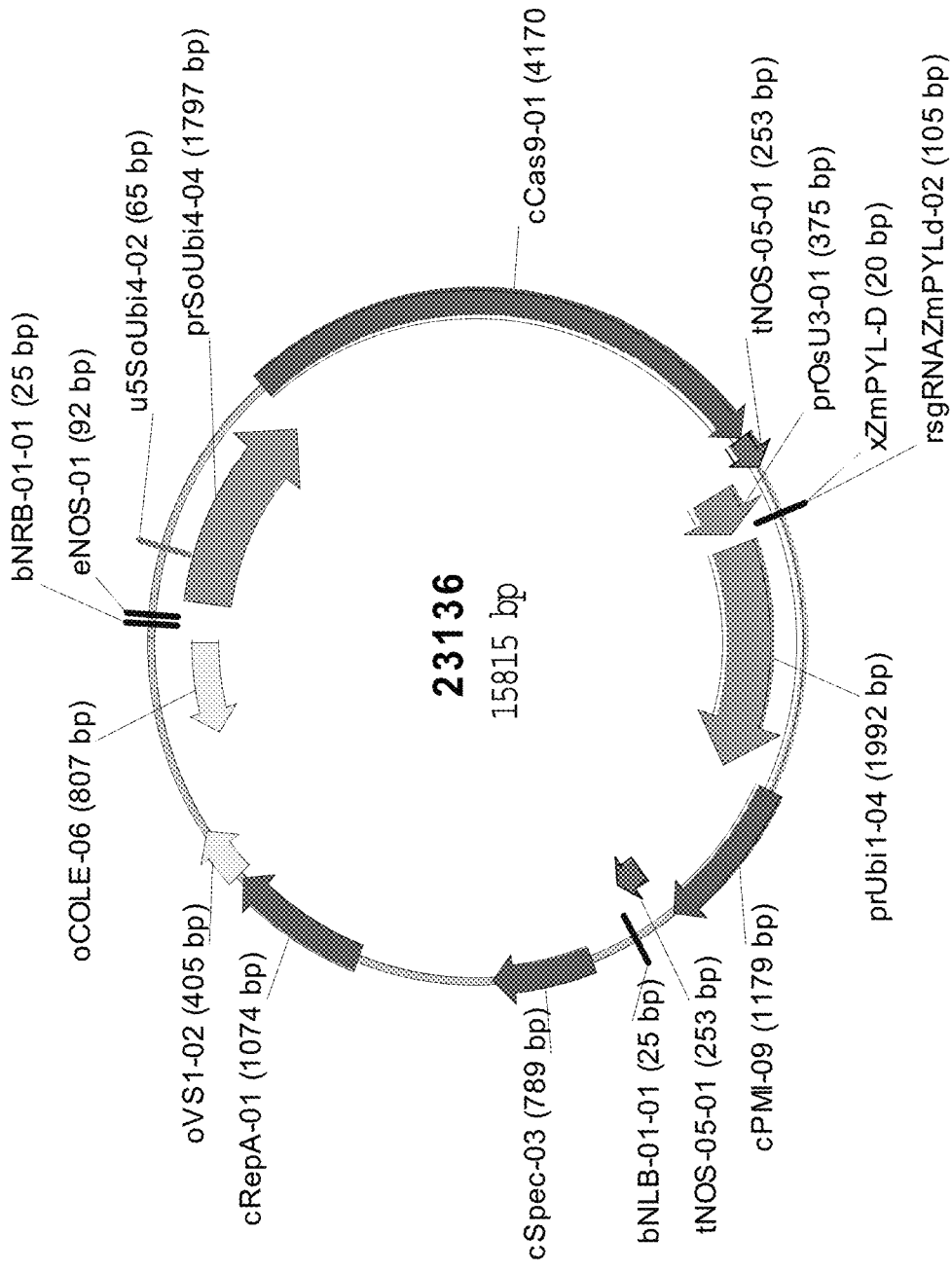
FIG. 9A-B provide a schematic map of binary plant transformation vectors 23136 and 23189 carrying expression cassettes for Cas9, gRNA and selectable marker gene PMI for mediating ZmPYL-D E169L mutagenesis.
Figure 9B:
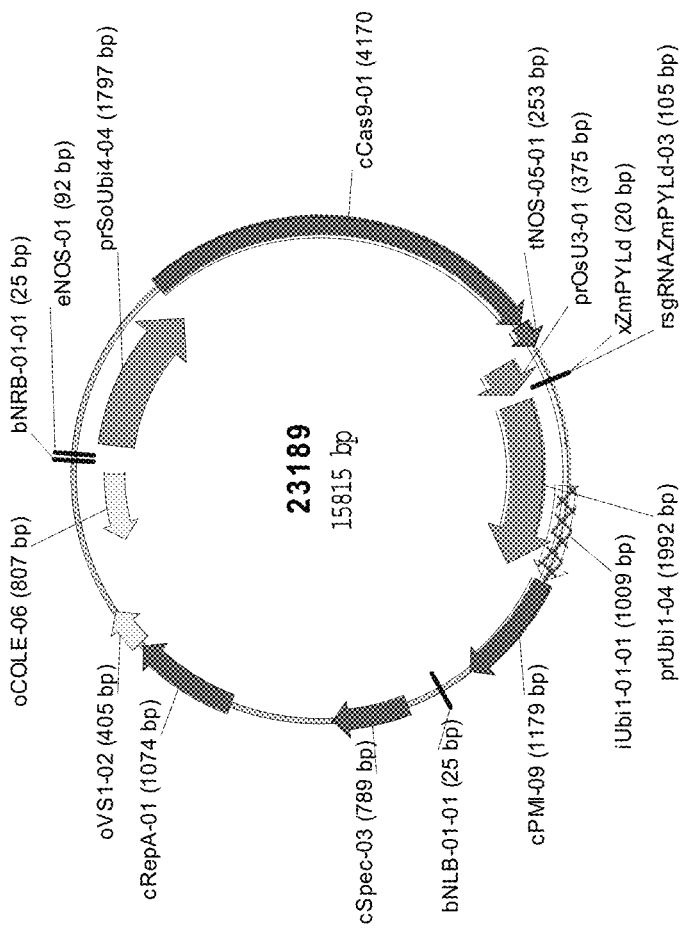
Figure 10A:
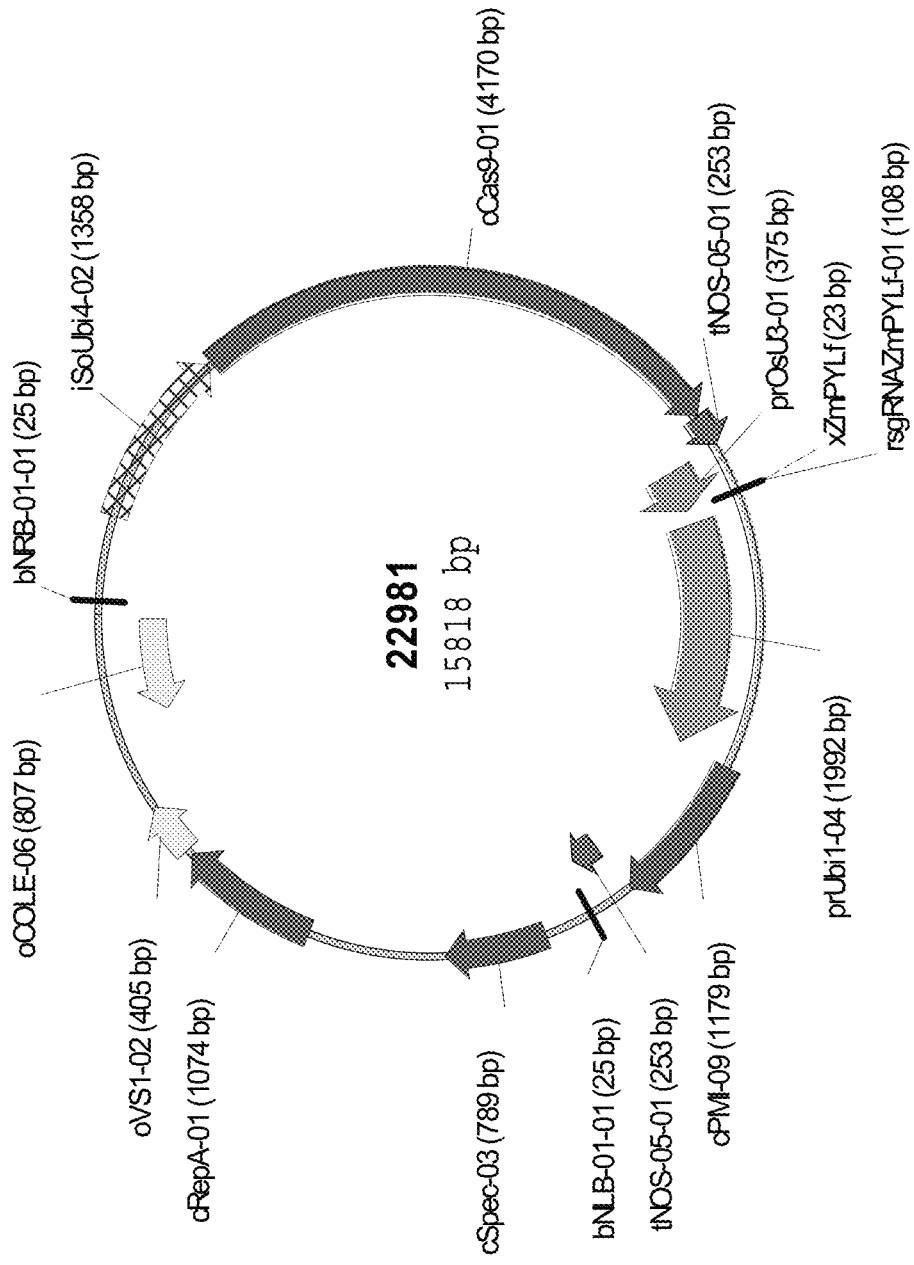
FIG. 10A-10B provide a schematic map of binary plant plant transformation vectors 22981 and 23191 carrying expression cassettes for Cas9, gRNA and selectable marker gene PMI for mediating ZmPYL-F E164L mutagenesis.
Figure 10B:
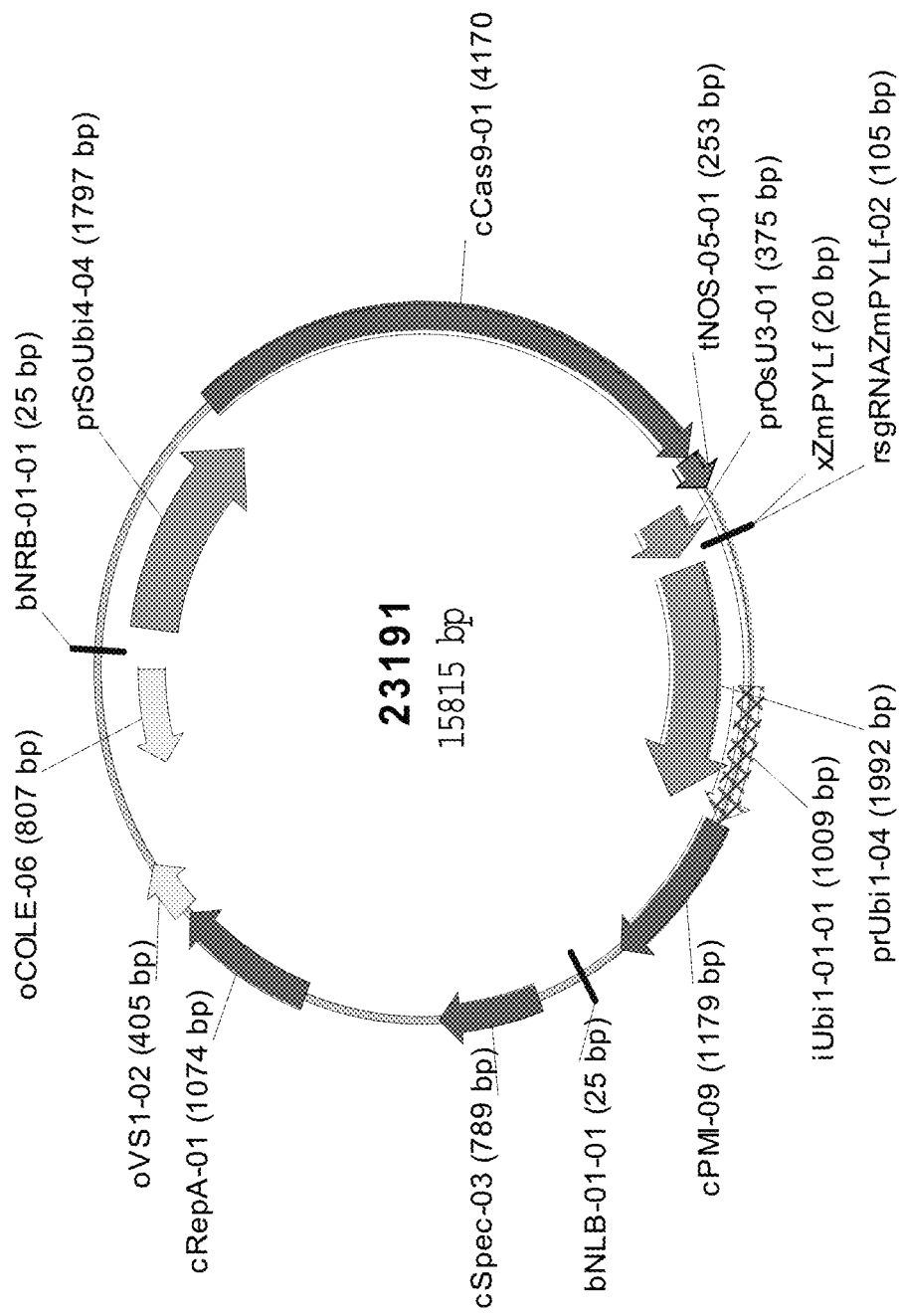
Figure 11:
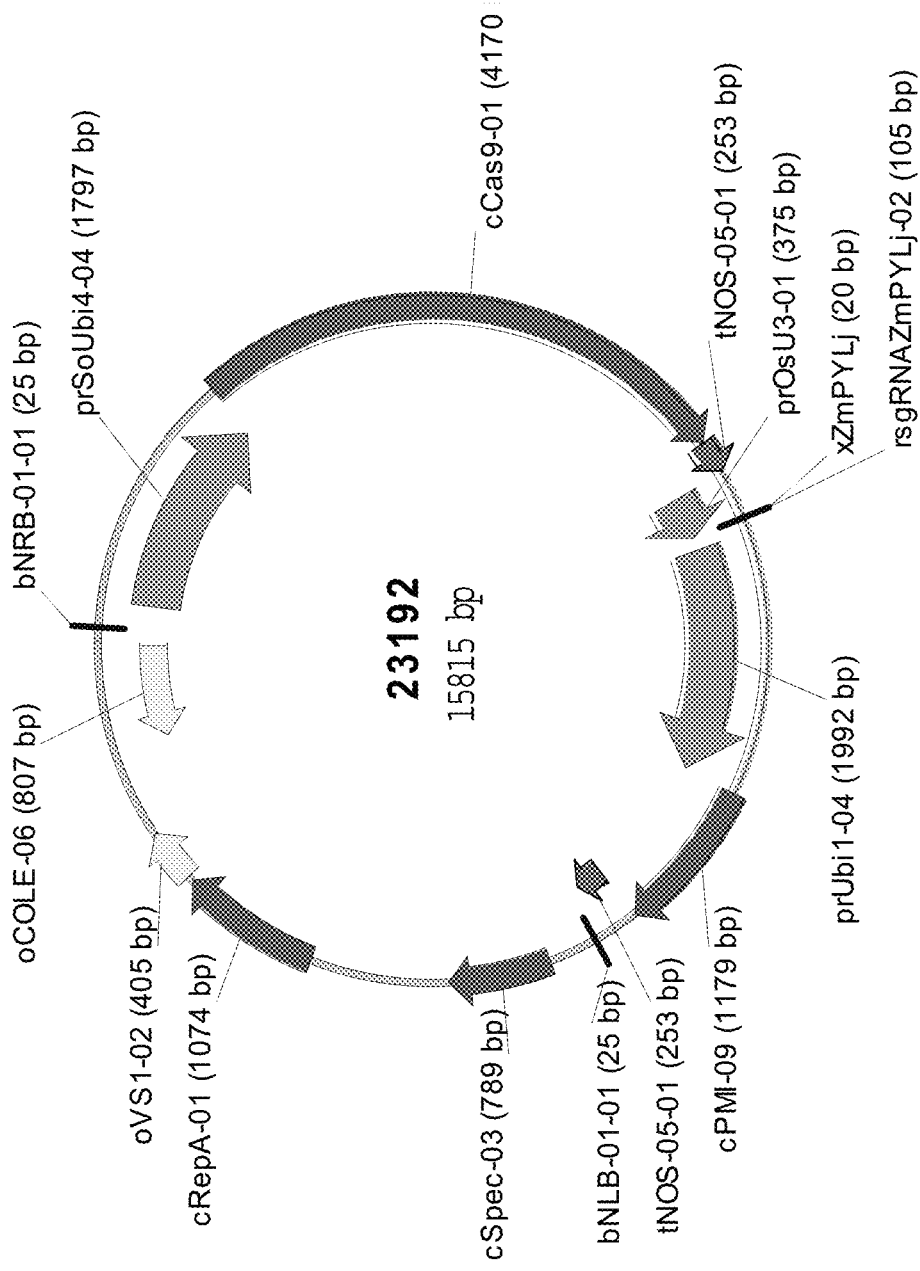
FIG. 11 provides a schematic map of binary plant plant transformation vector 23192 carrying expression cassettes for Cas9, gRNA and selectable marker gene PMI for mediating ZmPYL-E E148L.

Alternatively, the guide RNA can also be expressed from a different polymerase III promoter like rice U3 promoter (prOsU3) which initiates tracription after nucleotide A. The prOsU3-E149L gRNA expression cassette has the following sequences (SEQ ID NO:374) with the 20 bp targeting guide sequence (xZmPYLE-E149L or xZmPYLe, SEQ ID NO: 369) underlined. This prOsU3-E149L gRNA expression cassette along with PMI selectable marker gene cassette and prSoUbi4 driven Cas9 gene expression cassette are inserted into binary vector backbone to form transformation vector 23190 (FIG. 8).

(SEQ ID NO: 374)
```
5'-GGGAT CTTTA AACAT ACGAA CAGAT CACTT AAAGT TCTTG TGAAG CAACT TAAAG

TTATC AGGCA TGCAT GGATC TTGGA GGAAT CAGAT GTGCA GTCAG GGACC ATAGC

ACAGG ACAGG CGTCT TCTAC TGGTG CTACC AGCAA ATGCT GGAAG CCGGG AACAC

TGGGT ACGTT GGAAA CCACG TGATG TGGAG TAAGA TAAAC TGTAG GAGAA AAGCA

TTTCG TAGTG GGCCA TGAAG CCTTT CAGGA CATGT ATTGC AGTAT GGGCC GGCCC

ATTAC GCAAT TGGAC GACAA CAAAG ACTAG TATTA GTACC ACCTC GGCTA TCCAC

ATAGA TCAAA GCTGG TTTAA AAGAG TTGTG CAGAT GATCC GTGGC ACCTG GTGAT

CGAGT CGTTC GGTTT TAGAG CTAGA AATAG CAAGT TAAAA TAAGG CTAGT CCGTT

ATCAA CTTGA AAAAG TGGCA CCGAG TCGGT GCTTT TTTTT T-3'
```

4. Generation of Mutants with Targeted Genomic Sequence Modification in ZmPYL-E Gene 4.1 Generation of Targeted Mutation V89A in ZmPYL-E Gene with Biolistic Bombardment For target gene sequence modification mediated by homology-directed repair, donor DNA molecule needs to be co-delivered with Cas9 and gRNA. DNA molecule with at least 15 nucleotides flanking the Cas9 cleavage site and containing the intended mutant nucleotide(s) is used as repair donor. For modification of the target sequence 5'-CGCGA CGTCA ACGTC AA/GAC-3' to result in V89A mutation, the single underlined residue T needs to be converted to C so valine at position 89 (V89, GTC) is changed to alanine (A89, GCC). Since the intended Cas9 cleavage site (indicated by /) is 9 nucleotides downstream, preferably, the repair DNA molecule should contain sequences at least 15-nt upstream of TCA and 15-nt downstream of the underlined A in AA/GAC as in this sequence (5'-GCAGCCT GCGCGACGCC AACGTCAA/GA CCGGCCTGCC GGC-3') (SEQ ID NO:375). More preferably, the repair DNA molecule should contain sequences with at least 20-nt upstream of TCA and at least 20-nt downstream of the underlined A in AA/GAC as outlined in this sequence (5'-GG TCGGCAGCCT GCGCGACGCC AACGTCA A/GA CCGGCCTGCC GGCGACGA-3') (SEQ ID NO:376). More preferably, the repair DNA molecule should contain sequences with more than 30-nt upstream of TCA and more than 30-nt downstream of the underlined A in A A/GAC as outlined in this sequence (5'-AC CAGCTC GAGG TCGGCAGCCT GCGCGACGCC AACGTCA A/GA CCGGCCTGCC GGCGACGACC AGAACCGA-3') (SEQ ID NO:377). Most preferably, the repair DNA molecule should contain sequences with more than 50-nt upstream of TCA and more than 50-nt downstream of the underlined A in AA/GAC as indicated in this sequence (5'-GA ACTGCGTCGT GCGCGGGGAC CAGCTC GAGG TCGGCAGCCT GCGCGACGCC AACGTCA A/GA CCGGCCTGCC GGCGACGACC AGAACCGAGC GCCTCGAGCA GCTCGACGA-3') (SEQ ID NO:378). It should be noted that oligonucletoides with sequences corresponding to the opposite strand of SEQ ID NO:375 to SEQ ID NO:378 can also be used for mediating targeted V89A mutation.

To generate plants carrying V89A mutation, the above described repair donor DNA oligonucleotide (5'-AC CAGCTC GAGG TCGGCAGCCT GCGCGACGCC AACGTCAA/GA CCGGCCTGCC GGCGACGACC AGAACCGA-3') (SEQ ID NO:377) that comprise sequences 30-nt upstream of TCA and 30-nt downstream of the underlined A in AA/GAC is co-precipitated with pZmPYLE-V89A vector (FIG. 1) onto gold particles and bombarded into immature maize embryos (genotype A188, Hill or other applicable varieties). Methods for maize immature embryo bombardment, callus induction tissue regeneration and rooting methods have been described previously except here no mannose selection is required (Wright et al., 2001, Efficient biolistic transformation of maize (*Zea mays* L.) and wheat (*Triticum aestivum* L.) using the phosphomannose isomerase gene, pmi, as the selectable marker. *Plant Cell* Reports 20:429-436). Briefly, immature embryos are isolated from harvested immature ears at about 9-12 days after pollination and pre-cultured for 3 to 5 days on osmoticum media. Pre-cultured embryos are then bombarded with DNA vector ZmPYLE-V89A and the donor oligonucleotide using BioRad PDS-1000 Biolistic particle delivery system. Bombarded embryos are then incubated in callus induction media and then moved onto regeneration media to induce shoot formation. Shoots are then moved to rooting media. Preferably but not essential, a selectable marker gene cassette like PMI is also added to the ZmPYLE-V89A vector so only transformed cells containing an integrated gRNA or Cas9 expression cassette will be selected for regeneration. Samples are then harvested from regenerated plants for genotyping to identify plants containing the desired V89A mutation in the ZmPYL-E gene. Genotyping can be done with one or more of the standard mutation detection methods such as PCR amplification followed by sequencing, capillary electrophoresis and Nuclease Surveyer assay.

ZmPYLE-V89A vector carries the gRNA and Cas9 expression cassettes can also be delivered into maize cells using other physical delivery method such as protoplast transformation and silicon carbide whisker-mediated transformation. The repair donor DNA molecule can also be delivered into cells in the form of single- or double-stranded molecule that is present as part of a recombinant DNA molecule such as restriction fragment or plasmid or T-DNA or viral replicon for generation of transformed cells using methodologies known in the art. Alternatively, gRNA and Cas9 expression vectors and repair donor vector can be transformed into maize cells with *Agrobacterium*-mediated transformation. It should be noted that for targeted modification, no integration of Cas9 or gRNA expression vector is required or even preferred. Therefore, these vectors can be delivered transiently by biolistic transformation or *Agrobacterium*-mediated transformation.

4.2 Generation of Targeted Mutation E149L in ZmPYL-E Gene with Biolistic and *Agrobacterium*-Mediated Transformation Similar to the above example (Section 4.1) for generating ZmPYLE-V89A mutation, targeted E149L mutation (Table 1) can be introduced into ZmPYL-E gene using biolistic bombardment using DNA vectors carrying Cas9 and gRNA expression cassettes such as these shown in FIG. 6 and FIG. 8 along with repair donor DNA sequences containing the desired mutation such as in the form of purified oligonucleotide with this sequence (ZmPYL-Eb, SEQ ID NO:379, 5'-TGACG GGAGG CCGGG CACCC TGGTG ATCCT GTCGT TCGTA GTCGA TGTGC CTGAT GGCAA-3', Table 2). Other forms of repair donor oligonucleotides can be used too. For example, the oligonucleotides can be longer or in the complimentary strand or contain chemical modifications (e.g. phosphorothioate or methylphosphonate) to enhance stability or affinity to the target sequences. Chemically modified oligonucletoides have been described (Deleavey and Damha, 2012, Chemistry & Biology, on the world wide web at dx.doi.org/10.1016/j.chem- bio1.2012.07.011). To demonstrate utility of such chemically modified oligonucleotides, experiments were done using oligonucleotides with sequences from the non-coding strand and also containing phosphorothioate linkage (Table 2, ZmPYL-Ec-NT-PM, SEQ ID NO:380, 5'-T*T*C*GT GTTGC CATCA GGCAC ATCGA CTACG AACGA CAGGA TCACC AGGGT GCCCG GCCTC CCGTC AATG*C* T*C-3', * denotes the presence of phosphorothioate linkage between nucleotides).

Targeted mutation E149L in ZmPYL-E gene can also be generated with DNA molecules delivered via *Agrobacterium*. *Agrobacterium*-mediated transformation methods have been described elsewhere (Ishida et al. (1996). High efficiency transformation of maize (*Zea mays* L.) mediated by *Agrobacterium tumefaciens*. *Nat. Biotechnol.* 14, 745-750; Negrotto et al. (2000). Theuse of phosphomannose-isomerase as a selectable marker to recover transgenic maize plants (*Zea mays* L.) via *Agrobacterium* transformation. Plant Cell Rep. 19, 798-803). Briefly, the prOsU6-E149L (SEQ ID NO:373) or prOsU3-E148L (SEQ ID NO:374) gRNA expression cassette is cloned into a binary vector carrying PMI selectable marker cassette and also an expression cassette for Cas9 with maize preferred codons forming transformation vector pZmPYLE-E149L and 23190 (FIG. 6, FIG. 8, Table 1). These vectors can be used to deliver Cas9 and gRNA expression cassettes into maize cells with *Agrobacterium*-mediated transformation. The repair donor DNA molecule containing the intended mutant sequences (5'-TGACG GGAGG CCGGG CACCC TGGTG ATCCT GTCGT TCGTA GTCGA TGTGC CTGAT GGCAA-3') (SEQ ID NO:379) is co-delivered into cells from a separate T-DNA molecule. However, it can be also be inserted into the T-DNA region next to the gRNA and Cas9 expression cassettes in the binary vector pZmPYLE-E149L or 23190 (FIG. 2). The donor repair template can also be delivered in the form of viral replicon derived from another T-DNA (Baltes et al. 2014, DNA replicons for plant genome engineering. *Plant Cell*. 26:151-163). PMI marker is used to select for transgenic plants with integrated Cas9 or gRNA expression cassette. However, it should be noted that stable transformation of transformation vectors is not essential or even preferred for generating desired mutations as long as enough plants are screened since transient expression of Cas9 and gRNA is sufficient to result in cleavage of the chromosomal target sequence to induce DNA repair. However, it should be noted that for targeted modification, no integration of Cas9 or gRNA expression vector is required or even preferred.

4.3 Generation of Multiple Amino Acid Modifications in ZmPYL-E Gene Simultaneously It should be noted that more than one target can be modified at the same time if gRNAs and repair donors for multiple target sequences are present at the same time. For example, both V89A and E149L mutations can be obtained by co-bombarding vector pZmPYLE-V89A-E149L containing expression cassettes for Cas9 and two gRNAs (FIG. 7) along with both repair donor DNA templates, V89A oligonucleotide (5'-AC CAGCTC GAGG TCGGCAGCCT GCGCGACGCC AACGTCAA/GA CCGGCCTGCC GGCGACGACC AGAACCGA-3')(SEQ ID NO:377) and E149L oligonucleotides ODN-ZmPYL-Eb (5'-TGACG GGAGG CCGGG CACCC TGGTG ATCCT GTCGT TCGTA GTCGA TGTGC CTGAT GGCAA-3') (SEQ ID NO:379) or ODN-ZmPYL-Ec-NT-PM (SEQ ID NO:380, 5'-T*T*C*GT GTTGC CATCA GGCAC ATCGA CTACG AACGA CAGGA TCACC AGGGT GCCCG GCCTC CCGTC AATG*C* T*C-3', * denotes the presence of phosphorothioate linkage between nucleotides).

As described for generating plants with single mutations, bombarded embryos are then incubated in callus induction media and then moved onto regeneration media to induce shoot formation. Shoots are then moved to rooting media. PMI marker can be used to select for transgenic plants with integrated Cas9 or gRNA expression cassette. However, it should be noted again that stable transformation of transformation vectors is not essential or even preferred for generating desired mutations as long as enough plants are screened to identify plants with desired mutations since transient expression of Cas9 and gRNA is sufficient to result in cleavage of the chromosomal target sequence to induce DNA repair. Samples are then harvested from regenerated plants for genotyping to identify plants containing the desired V89A and E149L mutations in the ZmPYL-E gene. Genotyping can be done with one or more of the standard mutation detection methods such as PCR amplification followed by sequencing, capillary electrophoresis and Nuclease Surveyer assay.

4.4 Generation of Additional Targeted Mutations at V89 Position in ZmPYL-E Gene

Alternate site-directed changes can be introduced at the V89 position of the ZmPYL-E to obtain ABA hypersensitive mutations by using similar method described above for creating V89A mutation except that repair donor oligonucleotide sequences need to be changed to introduce the corresponding mutations. For example, V89I and V89Y mutations can be introduced by using the same gRNAs (SEQ ID NOS: 363 to 367) to guide Cas9 cleavage of the ZmPYL-E target. Expressing cassettes for gRNA and Cas9 can be delivered into maize cells simultaneously by any physical or biological methods such as biolistic bombardment or *Agrobacterium*-mediated transformation. For introduction of V89I mutation, the single underlined residue G in the ZmPYL-E genomic target sequence 5'-CGCGA CGTCA ACGTC AA/GAC-3' needs to be converted to A, so valine at position 89 (V89, GTC) is changed to isoleucine (I89, ATC). Since the intended Cas9 cleavage site (indicated by /) is 9 nucleotides downstream, preferably, the repair DNA molecule should contain sequences at least 15-nt upstream of GTC and 15-nt downstream of the underlined A in A A/GAC as in this sequence (5'-GGCAGCCT GCGCGAC ATC AACGTCAAGA CCGGCCTGCC GGC-3') (SEQ ID NO:381). More preferably, the repair DNA molecule should contain sequences with at least 20-nt upstream of ATC and at least 20-nt downstream of the underlined A in AAGAC as outlined in this sequence (5'-AGG TCGGCAGCCT GCGCGACATC AACGTCAAGA CCGGCCTGCC GGCGACGA-3') (SEQ ID NO:382). More preferably, the repair DNA molecule should contain sequences with more than 30-nt upstream of ATC and more than 30-nt downstream of the underlined A in AAGAC as outlined in this sequence (5'-GAC CAGCTC GAGG TCGGCAGCCT GCGCGACATC AACGTCAAGA CCGGCCTGCC GGCGACGACC AGAACCGA-3') (SEQ ID NO:383). Most preferably, the repair DNA molecule should contain sequences with more than 50-nt upstream of ATC and more than 50-nt downstream of the underlined A in AAGAC as indicated in this sequence (5'-GGA ACTGCGTCGT GCGCGGGGAC CAGCTC GAGG TCGGCAGCCT GCGCGACATC AACGTCAAGA CCGGCCTGCC GGCGACGACC AGAACCGAGC GCCTCGAGCA GCTCGACGA-3') (SEQ ID NO:384).

For introduction of V89Y mutation, the two underlined residues GT in the maize genomic target sequence 5'-CGCGA CGTCA ACGTC AA/GAC-3' (SEQ ID NO: 362) need to be converted to TA, so the valine residue at position 89 (V89, GTC) is changed to tyrosine (Y89, TAC). Since the intended Cas9 cleavage site (indicated by /) is 9 nucleotides downstream, preferably, the repair DNA molecule should contain sequences at least 15-nt upstream of GTC and 15-nt downstream of the underlined A in AA/GAC as in this sequence (5'-GGCAGCCT GCGCGACTAC AACGTCAAGA CCGGCCTGCC GGC-3') (SEQ ID NO:385). More preferably, the repair DNA molecule should contain sequences with at least 20-nt upstream of TAC and at least 20-nt downstream of the underlined A in AAGAC as outlined in this sequence (5'-AGG TCGGCAGCCT GCGCGACTAC AACGTCAAGA CCGGCCTGCC GGCGACGA-3') (SEQ ID NO:386). More preferably, the repair DNA molecule should contain sequences with more than 30-nt upstream of TAC and more than 30-nt downstream of the underlined A in AAGAC as outlined in this sequence (5'-GAC CAGCTC GAGG TCGGCAGCCT GCGCGACTAC AACGTCAAGA CCGGCCTGCC GGCGACGACC AGAACCGA-3') (SEQ ID NO:387). Most preferably, the repair DNA molecule should contain sequences with more than 50-nt upstream of TAC and more than 50-nt downstream of the underlined A in AA/GAC as indicated in this sequence (5'-GGA ACTGCGTCGT GCGCGGGGAC CAGCTC GAGG TCGGCAGCCT GCGCGACTAC AACGTCAAGA CCGGCCTGCC GGCGACGACC AGAACCGAGC GCCTCGAGCA GCTCGACGA-3') (SEQ ID NO:388).

Similarly, double mutants containing V89I (or V89Y) and E149L (see, e.g., SEQ ID NOS:390, 391 and 392) can be obtained by transforming maize cells with vectors containing expression cassettes for Cas9 and two gRNAs along with oligonucleotides to introduce corresponding mutations (E149L, V89I or V89Y) as described above in section 4.3.

5. Generation of Targeted E169L Genomic Sequence Modification in Additional ZmPYL Gene Family Members, ZmPYL-D, ZmPYL-F and ZmPYL-J 5.1 Mutagenesis Targets and gRNA Design Similar to examples described above for endogenous ZmPYL-E gene (Example 4 and Table 1), additional ZmPYL gene family members were also chosen for targeted genome editing to replace specific nucleotides so the amino acid residue corresponding to $E^{169}$ in the ABA receptors (ZmPYL-D, ZmPYL-F and ZmPYL-J) is changed to a hypersenstive form $L^{169}$. These intended changes are summarized in Table 1. These experiments aimed to modify the corresponding conserved amino acid residue E (glutamic acid) into L (Leucine) in homologous ZmPYL genes.

TABLE 1

ZmPYL mutations and gRNA sequences and transformation vectors

| ZmPYL gene | WT maize protein sequence | Desired mutant protein sequence | gRNA target sequence in transformation vector (SEQ. ID. NO. and notes) | Transformation vector name |
|---|---|---|---|---|
| ZmPYL-E (GRMZM2G165567_P02) | LVI$\underline{E}^{149}$SFV | LVI$\underline{L}^{149}$SFV | 5'-cctgg tgatc gagtc gttcg-3' (SEQ. ID. NO: 369; target site in coding strand, base replacement 5 bp away from the Cas9 cleavage site) | 23190 |
| ZmPYL-D (GRMZM2G048733_P02) | TLVI$\underline{E}^{169}$SFV | TLVI$\underline{L}^{169}$SFV | 5'-gtcgg ggacg tcgac gacga-3' (SEQ. ID. NO: 393; target site in template strand, base replacement 8 bp away from the Cas9 cleavage site) | 23136 |
| ZmPYL-D (GRMZM2G048733_P02) | LVI$\underline{E}^{169}$SFV | LVI$\underline{L}^{169}$SFV | 5'-gaggt catcg acggc cggcc-3' (SEQ. ID. NO: 394; target site in coding strand, base replacement 19 bp away from the Cas9 cleavage site) | 23189 |
| ZmPYL-F (GRMZM2G053882_P01) | LVI$\underline{E}^{164}$SFV | LVI$\underline{L}^{164}$SFV | 5'-gctcg tgatc gagtc cttcg tgg-3' (SEQ. ID. NO: 395; longer targeting guide sequence (23 bp), target site in coding strand, base replacement 8 bp away from the Cas9 cleavage site) | 22981 |
| ZmPYL-F (GRMZM2G053882_P01) | LVI$\underline{E}^{164}$SFV | LVI$\underline{L}^{164}$SFV | 5'-gctcg tgatc gagtc cttcg-3' (SEQ. ID. NO: 396; shorter targeting guide sequence (20 bp), target site in coding strand, base replacement 5 bp away from the Cas9 cleavage site) | 23191 |
| ZmPYL-J (GRMZM2G154987_P01) | VVL$\underline{E}^{148}$SYV | VVL$\underline{E}^{148}$SYV | 5'-cgtcg acgac gtagg actcg-3' (SEQ. ID. NO: 397; target site in template strand, base replacement at the Cas9 cleavage site) | 23192 |

5.2 Constructions of Vectors for Expression of gRNAs Targeting ZmPYL-D, ZmPYL-F and ZmPYL-J Genes Similar to examples described above for constructing 23190 for expressing gRNA for endogenous ZmPYL-E gene (Example 4), transformation vectors expressing Cas9 and different gRNAs (Table 1) for ZmPYL-D (23136 and 23189), ZmPYL-F (22981 and 23191) and ZmPYL-J (23192) genes were constructed (FIGS. 9A-9B, 10A-10B and 11). The gRNA targeting sequence for different ZmPYL genes are listed in Table 1 (SEQ ID NO:393 to 397). In these vectors, the whole gRNA coding regions [~20 nucleotide targeting guides (SEQ ID NO:393 to 397), tracRNA scaffold and PolIII termination sequences (5'-GTTTT AGAGC TAGAA ATAGC AAGTT AAAAT AAGGC TAGTC CGTTA TCAAC TTGAA AAAGT GGCAC CGAGT CGGTG CTTTT TTTTT-3'(SEQ ID NO:413))] were placed under the control of rice polymerase III U3 promoter (prOsU3). These vectors also contain a PMI selectable marker gene cassette for selecting stable transformants. These vectors can be used for transformation mediated by *Agrobacterium*-mediated trasnformation or used directly for particle bomdbarment.

5.3 Generation of Genome Edited Novel Alleles (Targeted Mutagenesis and Allele Replacement Mutants) Mediated CRISPR-Cas in ZmPYL-D, ZmPYL-F and ZmPYL-J Genes Novel alleles including targeted mutagenesis and allele replacement mutants can be generated via CRISPR-Cas system in the presence of repair donor DNA by *Agrobacterium*-mediated trasnformation or particle bomdbarment as described in Example 4 for ZmPYL-E. Here specific examples are provided for targeted mutations in ZmPYL-D, ZmPYL-F and ZmPYL-J genes using biolistic co-delivery of transformation vectors (Table 1 and FIG. 9A-B to 11) and repair donor oligodeoxynucleotides with desired mutations (Table 2 and Seq ID NO:398 to 410). Oligodeoxynucleotides (ODNs) of different length, strand (coding and non-coding template) or modification (with and without phosphorothioate linkage modification at the ends) (Seq ID NO:397 to 409) were used to mediate mutagenesis in different ZmPYL genes.

TABLE 2

Repair donor DNA oligonucleotide sequences

| ZmPYL gene | Cas9 and gRNA expression vector(s) | Oligodeoxynucleotide (ODN) | Length (nt) | Notes | Seq. ID. No. |
|---|---|---|---|---|---|
| ZmPYL-D | 23136 | ODN-ZmPYL-Dc | 75 | PAM #1 and target site in template strand, base replacement 8 bp away from the Cas9 cleavage site | Seq. ID. No. 398 |
| ZmPYL-D | 23136 | ODN- ZmPYL-Dd-NT | 75 | PAM#1 and target site in template strand, base replacement 8 bp away from the Cas9 cleavage site; PAM in donor ODN removed | Seq. ID. No. 399 |

TABLE 2-continued

Repair donor DNA oligonucleotide sequences

| ZmPYL gene | Cas9 and gRNA expression vector(s) | Oligodeoxynucleotide (ODN) | Length (nt) | Notes | Seq. ID. No. |
|---|---|---|---|---|---|
| ZmPYL-D | 23136 | ODN- ZmPYL-Dd-NT-PM | 75 | PAM#1 and target site in coding strand, base replacement 8 bp away from the Cas9 cleavage site; PAM in donor ODN removed; ODN with phosphorothioate linkage modification | Seq. ID. No. 400 |
| ZmPYL-D | 23189 | ODN-ZmPYL-Db | 88 | PAM #2 and target site in coding strand, base replacement 19 bp away from the Cas9 cleavage site; PAM in donor ODN removed; | Seq. ID. No. 401 |
| ZmPYL-E | 23190 | ODN- ZmPYL-Eb | 60 | Target site in coding strand, base replacement 5 bp away from the Cas9 cleavage site; ODN in non-coding strand; PAM in donor ODN removed | Seq. ID. No. 379 |
| ZmPYL-E | 23190 | ODN- ZmPYL-Ec-NT-PM | 72 | Target site in coding strand, base replacement 5 bp away from the Cas9 cleavage site; ODN with phosphorothioate linkage modification; PAM in donor ODN removed | Seq. ID. No. 380 |
| ZmPYL-F | 22981, 23191 | ODN-ZmPYL-Fa | 60 | Target site in coding strand, base replacement 5 or 8 bp away from the Cas9 cleavage site; PAM in donor ODN not removed | Seq. ID. No. 402 |
| ZmPYL-F | 22981, 23191 | ODN- ZmPYL-Fb | 60 | Target site in coding strand, base replacement 5 or 8 bp away from the Cas9 cleavage site; PAM in donor ODN removed | Seq. ID. No. 403 |
| ZmPYL-F | 22981, 23191 | ODN- ZmPYL-Fc | 77 | Target site in coding strand, base replacement 5 or 8 bp away from the Cas9 cleavage site; PAM in donor ODN removed | Seq. ID. No. 404 |
| ZmPYL-F | 22981, 23191 | ODN- ZmPYL-Fd-NT | 77 | Target site in coding strand, base replacement 5 or 8 bp away from the Cas9 cleavage site; PAM in donor ODN removed | Seq. ID. No. 405 |
| ZmPYL-F | 22981, 23191 | ODN- ZmPYL-Fd-NT-PM | 77 | Target site in coding strand, base replacement 5 or 8 bp away from the Cas9 cleavage site; PAM in donor ODN removed; ODN with phosphorothioate linkage modification | Seq. ID. No. 406 |
| ZmPYL-J | 23192 | ODN-ZmPYL-Jc short | 68 | Target site in template strand, base replacement at the Cas9 cleavage site; ODN in coding strand sequence | Seq. ID. No. 407 |
| ZmPYL-J | 23192 | ODN--ZmPYL-Jc-NT | 68 | Target site in template strand, base replacement at the Cas9 cleavage site; ODN in non-coding strand sequence | Seq. ID. No. 408 |
| ZmPYL-J | 23192 | ODN--ZmPYL-Jc-NT-PM | 68 | Target site in template strand, base replacement at the Cas9 cleavage site; ODN in non-coding strand sequence and with phosphorothioate linkage modification | Seq. ID. No. 409 |
| ZmPYL-J | 23192 | ODN--ZmPYL-Jc-long | 88 | Target site in template strand, base replacement at the Cas9 cleavage site; ODN in coding strand sequence | Seq. ID. No. 410 |

More specifically, the above described transformation vector (Table 2) expressing Cas9 and gRNA is mixed with its corresponding repair donor DNA oligonucleotides (SEQ ID NO:398 to 410) and then precipitated onto gold particles. The coated gold particles are then used to bombard immature maize embryos of elite inbred transformation variety NP2222 (DeFramond A J, et al (2013) Corn Event 5307. U.S. Pat. No. 8,466,346). Other maize genotype such as A188 and Hill can be used as bombardment target tissue source. Methods for maize immature embryo bombardment, callus induction tissue regeneration and rooting methods have been described previously except here no mannose selection is required (Wright et al., 2001, Efficient biolistic transformation of maize (*Zea mays* L.) and wheat (*Triticum aestivum* L.) using the phosphomannose isomerase gene, pmi, as the selectable marker. Plant Cell Reports 20:429-436). For example, for mutagenesis of ZmPYL-F gene mediated by CRISP-Cas9, immature embryos are isolated from harvested immature ears at about 9-12 days after pollination and pre-cultured for 3 to 5 days on osmoticum media. Pre-cultured embryos are then bombarded with DNA vector 22981 along with one of the oligonucleotides [ODN-ZmPYL-Fa, ODN-ZmPYL-Fb, ODN-ZmPYL-Fc, ODN-ZmPYL-Fd-NT or ODN-ZmPYL-Fd-NT-PM (Seq. ID. NO:402 to 406)] using BioRad PDS-1000 Biolistic particle delivery system. Bombarded embryos are then incubated in callus induction media and then moved onto mannose selection media. Selected calli are moved onto regeneration media to induce shoot formation. Shoots are then moved to rooting media. Samples are then harvested from regenerated plants for genotyping to identify plants containing the desired genomic sequence mutation that results in E164L amino acid change in the ZmPYL-F gene. Table 3 lists different experiments for targeted mutagenesis and allele replacement of different ZmPYL genes. In some experiments, gRNA and Cas9 expression vector was co-transformed with ZsGreen fluorescent protein vector 12672 for assessing gene delivery efficiency. In some other experiments, two or more gRNA expression vectors were co-delivered with two or more repair donor oligodexynucleotides to mutate two or ZmPYL genes simultaneously (Table 3). Table 3 shows that ZmPYL-F in a high percentage of PMI positive events (transformants) contain mutations at the intended sequences (SEQ ID NO:431: 5'-GCTCG TGATC GAGTC CTTCG/TGGTG GACGT-3', / indicated predicted Cas9 cleavage position) targeted by gRNA-Cas9.

to be further verified by sequencing. (4) PCR amplification of the target region followed by denaturation, heteroduplex

TABLE 3

Targeted mutagenesis and allele replacement experiments of different ZmPYL genes

| ZmPYL target gene | Transformation vector(s) | ODN(s) used for generating targeted mutation (s) | Number of experiments | Total number of immature embryos | Total number of PMI positive events | Number of events with mutation(s) at the target site* | Number of putative events with desired allele change |
|---|---|---|---|---|---|---|---|
| ZmPYL-D | 23136 | ODN-ZmPYL-Dc | 5 | 7914 | 279 | 132 | 3 |
| ZmPYL-D | 23136, 12672 | ODN-ZmPYL-Dc | 2 | 2102 | TBD | TBD | TBD |
| ZmPYL-D | 23189 | ODN-ZmPYL-Db | 1 | 1750 | TBD | TBD | TBD |
| ZmPYL-E | 23190 | ODN-ZmPYL-Eb | 2 | 2238 | 60** and TBD | 15 and TBD | 1 |
| ZmPYL-F | 22981 | ODN- ZmPYL-Fb | 6 | 5460 | 80 and TBD | 13 and TBD | TBD |
| ZmPYL-F | 22981, with other (22980, 22978, 22982)** | ODN- ZmPYL-Fb | 5 | 7225 | 346 and TBD | 171 and TBD | 6 and TBD |
| ZmPYL-F | 22981 | ODN- ZmPYL-Fc | 1 | 810 | TBD | TBD | TBD |
| ZmPYL-J | 23192 | ODN- ZmPYL-Jc short | 1 | 855 | TBD | TBD | TBD |
| ZmPYL-J | 23192 | ODN-ZmPYL-Jc long | 1 | 1605 | TBD | TBD | TBD |
| ZmPYL-E, ZmPYL-F | 23190, 23191 | ODN-ZmPYL-Eb, ODN-ZmPYL-Fc | 1 | 1785 | TBD | TBD | TBD |
| ZmPYL-F, ZmPYL-J | 23191 + 23192 | ODN-ZmPYL-Jd-S-NT, ODN-ZmPYL-Fd-NT | 1 | 1970 | TBD | TBD | TBD |
| ZmPYL-F, ZmPYL-J | 23191 + 23192 | ODN-ZmPYL-Jd-S-NT-PM, ODN-ZmPYL-Fd-NT-PM | 1 | 1505 | TBD | TBD | TBD |

Note:
*Event with both monoallelic and/or biallelic mutations;
**These vectors (22980, 22978 or 22982) carry cassettes for expression of control gRNAs (including NGG sequence) for testing specificity of gRNA for ZmPYL genes.
TBD, to be determined; experiments are in progress and no data is available at the moment.

Sequencing of ZmPYL-F target region in selected mutants confirmed qPCR results. FIG. 13 shows sequence alignment of targeted mutations in ZmPYL-F mediated by gRNA-Cas9 expressed from vector 22981.

5.4 Molecular Characterization of Edited ZmPYL Mutants

Leaf samples are harvested from regenerated plants in root vessels for molecular analysis or genotyping to identify plants containing mutations at the target sequence and also containing desired sequence mutations that results in desired amino acid change in the ZmPYL genes. Targeted mutants can be identified using one of the following methods: (1) PCR amplification of the target region followed by restriction enzyme digestion and gel electrophoresis if the mutated sequence contains a restriction site (Lloyd A et al. 2005. Proc. Natl. Acad. Sci. USA 102:2232-37; Zhang F, et al. 2010. Proc. Natl. Acad. Sci. USA 107:12028-33). This method is simple, but requires the presence of suitable restriction site, thus cannot be used for most targets. (2) PCR amplification of the target region followed by Sanger sequencing or deep sequencing (Gross, E. et al. 1999. Hum. Genet. 105, 72-78. Shukla V K, et al. 2009. Nature 459: 437-41. Townsend J A, et al. 2009. Nature 459:442-45); Sequencing approach is definitive and sensitive, but takes longer time and throughput can be limited by capacity. (3) PCR amplification of the target region followed by denaturation, annealing and capillary electrophoresis (Li-Sucholeik X C, et al. 1999. Electrophoresis 20, 1224-1232; Larsen L A, et al. 1999. Hum. Mutat. 13, 318-327) or denaturing high-performance liquid chromatography to detect base pair changes by heteroduplex analysis (McCallum C M, et al. 2000. Nature Biotechnology 18, 455-457); these methods are limited by throughput and the identified mutations need to be further verified by sequencing. (4) PCR amplification of the target region followed by denaturation, heteroduplex formation/strand annealing, digestion with mismatch-specific nuclease (such as CEL1 and T7 endonuclease) and gel electrophoresis (Oleykowski, C. A. et al. 1998. Nucleic Acids Res. 26, 4597-4602. Colbert et al. 2001. Plant Physiol. 126:480-484; Lombardo A, et al. 2007. Nat. Biotechnol. 25:1298-306), for example using the commercially available Surveyer™ nuclease assay kit (Transgenomic, Gaithersburg, Md., USA; Qiu, P., et al. 2004. BioTechniques 36, 702-707). However, the gel-based assays are not as sensitive as high-throughput DNA sequencing and can only detect mutation with frequency of 1% or more. All of the above 4 approaches of identifying a potential mutant in a target site are based on the presence of a new signal in a qualitative fashion, either a new band in a gel or a new peak in a chromatogram that is different from the wild type reference sequence.

We have developed an alternative high throughput assay method for identification of plants with any site-directed mutation at the targeted sequences based on qPCR (Syngenta Provisional Patent Application #9207-137PR, case 80484). The method measures the reduction of the wild type target site sequence in cells or tissues that have been treated with a site-directed nuclease in a quantitative fashion in comparison with a reference sample. Typically, a Taqman-based assay is used for quantification of the target sequence copy numbers. For detecting potential events with desired allele replacement, an additional high throughput end-point assay is designed and performed. In this end point assay, signals from two MGB probes are used to determine the presence of WT or expected mutant allele as shown in FIG. 12. Events with putative allele replacement are selected based on both Taqman copy number assay (WT target sequence copy number) and end point assay (mutant copy number) results. Putative events with putative allele replacement are further confirmed by DNA sequence analysis of amplified target locus sequences. Table 4 shows the qPCR and end point assay results of selected number of regerated maize plants generated from biolistic transformation experiment of vector 22981 (FIG. 10A-10B) co-delivered with oligonucleotide ODN-ZmPYL-Fb (Seq. ID.No. 402). As shown in Table 4, transformation vector-specific assays were performed to determine if there is any transgene insertion (cCas9-01 and cPMI-09 qPCR assays). qPCR assay (ZmPYL-F cutting site) was also performed to determine the copy number of the ZmPYL-F maize genomic target site sequence (5'-GCTCG TGATC GAGTC CTTCG/TGG-3', SEQ ID NO:394). Finally, an end point assay (ZmPYL-F E164L) was also used to determine if plants have intended sequence mutation (from GAG to CTG) resulting in E164L amino acid residue change. For example, plant MZET151104A015A has a single copy of transgene insertion (for Cas9 and PMI genes), biallelic mutations at the target sequence since ZmPYL-F cutting site copy call is 0 (in WT, the copy call should be 2) and no E164L mutation. Another plant MZET151104A125A has more than 2 copies of transformation vector (22981) insertion and only one copy of the ZmPYL-F cutting site is mutated. But plant MZET151104A125A is positive for end point assay for detecting ZmPYL-F E164L mutation. This event is thus a candidate event with ZmPYL-F E164L mutation. Candidate events MZET151104A125A, MZET151104A174A and MZET151104A180A in Table 4 are then further confirmed by sequencing analysis of PCR-amplified ZmPYL-F genome sequences.

TABLE 4 qPCR and end point assay results of regenerated maize events

| Plant ID | Assay name (Type) Construct ID | Assays for transgene vector | | Assay s for genomic target sequence ZmPYL-F | | Candidate event |
|---|---|---|---|---|---|---|
| | | cCas9-01 (qPCR) Copy number | cPMI-09 (qPCR) Copy number | cutting site (qPCR) Copy number | ZmPYL-F E164L (End point) Null/Het/Hom | |
| MZET151104A015A | 22981 | 1 | 1 | 0 | Null | |
| MZET151104A017A | 22981 | 1 | 1 | 1 | Null | |
| MZET151104A019A | 22981 | >2 | >2 | 0 or 1 | Null | |
| MZET151104A021A | 22981 | 1 | 1 | 1 | Null | |
| MZET151104A125A | 22981 | >2 | 2 | 1 | Het | Yes |
| MZET151104A126A | 22981 | >2 | >2 | 1 | Null | |
| MZET151104A132A | 22981 | 1 | 1 or 2 | 1 or 2 | Null | |
| MZET151104A138A | 22981 | 1 | 1 | 0 | Null | |
| MZET151104A141A | 22981 | 1 or 2 | 1 | 0 | Null | |
| MZET151104A158A | 22981 | >2 | 2 | 1 | Null | |
| MZET151104A174A | 22981 | >2 | >2 | 1 | Het | Yes |
| MZET151104A178A | 22981 | >2 | 1 | 1 | Null | |
| MZET151104A180A | 22981 | >2 | 1 | 1 | Het | Yes |
| MZET151104A186A | 22981 | >2 | >2 | 0 or 1 | Null | |
| MZET151104A195A | 22981 | >2 | >2 | 0 | Null | |
| MZET151104A201A | 22981 | 0 | 0 | 1 | Null | |

5.5 Evaluation of ZmPYL Gene Edited Mutants

ZmPYL gene edited mutants are tested as described for transgenic T6PP maize plants (Nuccio et al., 2015, Nature Biotechnology, doi:10.1038/nbt.3277) with managed stress environment (MSE) trials. Mutant lines that show improved plant response to water deficit are further tested in multiple location agronomic equivalency (Ag Eq) trials with mutant lines grown alongside control plants and using a checkerboard plot layout.

PYL-E V89A (SEQ ID NO: 389)

Met Val Gly Leu Val Gly Gly Ser Thr Ala Arg Ala Glu His Val Val
1               5                   10                  15

Ala Asn Ala Gly Gly Glu Ala Glu Tyr Val Arg Arg Met His Arg His
            20                  25                  30

Ala Pro Thr Glu His Gln Cys Thr Ser Thr Leu Val Lys His Ile Lys
            35                  40                  45

Ala Pro Val His Leu Val Trp Glu Leu Val Arg Arg Phe Asp Gln Pro
        50                  55                  60

Gln Arg Tyr Lys Pro Phe Val Arg Asn Cys Val Val Arg Gly Asp Gln
65                  70                  75                  80

-continued

```
Leu Glu Val Gly Ser Leu Arg Asp Ala Asn Val Lys Thr Gly Leu Pro
             85                  90                  95

Ala Thr Thr Ser Thr Glu Arg Leu Glu Gln Leu Asp Asp Leu His
            100                 105                 110

Ile Leu Gly Val Lys Phe Val Gly Gly Asp His Arg Leu Gln Asn Tyr
            115                 120                 125

Ser Ser Ile Ile Thr Val His Pro Glu Ser Ile Asp Gly Arg Pro Gly
        130                 135                 140

Thr Leu Val Ile Glu Ser Phe Val Val Asp Val Pro Asp Gly Asn Thr
145                 150                 155                 160

Lys Asp Glu Thr Cys Tyr Phe Val Glu Ala Val Ile Lys Cys Asn Leu
                165                 170                 175

Asn Ser Leu Ala Glu Val Ser Glu Gln Leu Ala Val Glu Ser Pro Thr
            180                 185                 190

Ser Leu Ile Asp Gln
        195
```

PYL-E V89A E149L                                          (SEQ ID NO: 390)

```
Met Val Gly Leu Val Gly Gly Ser Thr Ala Arg Ala Glu His Val Val
 1               5                  10                  15

Ala Asn Ala Gly Gly Glu Ala Glu Tyr Val Arg Arg Met His Arg His
             20                  25                  30

Ala Pro Thr Glu His Gln Cys Thr Ser Thr Leu Val Lys His Ile Lys
            35                  40                  45

Ala Pro Val His Leu Val Trp Glu Leu Val Arg Arg Phe Asp Gln Pro
        50                  55                  60

Gln Arg Tyr Lys Pro Phe Val Arg Asn Cys Val Val Arg Gly Asp Gln
65                  70                  75                  80

Leu Glu Val Gly Ser Leu Arg Asp Ala Asn Val Lys Thr Gly Leu Pro
             85                  90                  95

Ala Thr Thr Ser Thr Glu Arg Leu Glu Gln Leu Asp Asp Leu His
            100                 105                 110

Ile Leu Gly Val Lys Phe Val Gly Gly Asp His Arg Leu Gln Asn Tyr
            115                 120                 125

Ser Ser Ile Ile Thr Val His Pro Glu Ser Ile Asp Gly Arg Pro Gly
        130                 135                 140

Thr Leu Val Ile Leu Ser Phe Val Val Asp Val Pro Asp Gly Asn Thr
145                 150                 155                 160

Lys Asp Glu Thr Cys Tyr Phe Val Glu Ala Val Ile Lys Cys Asn Leu
                165                 170                 175

Asn Ser Leu Ala Glu Val Ser Glu Gln Leu Ala Val Glu Ser Pro Thr
            180                 185                 190

Ser Leu Ile Asp Gln
        195
```

PYL-E V89I E149L                                          (SEQ ID NO: 391)

```
Met Val Gly Leu Val Gly Gly Ser Thr Ala Arg Ala Glu His Val Val
 1               5                  10                  15

Ala Asn Ala Gly Gly Glu Ala Glu Tyr Val Arg Arg Met His Arg His
             20                  25                  30

Ala Pro Thr Glu His Gln Cys Thr Ser Thr Leu Val Lys His Ile Lys
            35                  40                  45

Ala Pro Val His Leu Val Trp Glu Leu Val Arg Arg Phe Asp Gln Pro
        50                  55                  60

Gln Arg Tyr Lys Pro Phe Val Arg Asn Cys Val Val Arg Gly Asp Gln
```

-continued

```
                65                  70                  75                  80
Leu Glu Val Gly Ser Leu Arg Asp Ile Asn Val Lys Thr Gly Leu Pro
                        85                  90                  95

Ala Thr Thr Ser Thr Glu Arg Leu Glu Gln Leu Asp Asp Asp Leu His
                100                 105                 110

Ile Leu Gly Val Lys Phe Val Gly Gly Asp His Arg Leu Gln Asn Tyr
                115                 120                 125

Ser Ser Ile Ile Thr Val His Pro Glu Ser Ile Asp Gly Arg Pro Gly
                130                 135                 140

Thr Leu Val Ile Leu Ser Phe Val Val Asp Val Pro Asp Gly Asn Thr
145                 150                 155                 160

Lys Asp Glu Thr Cys Tyr Phe Val Glu Ala Val Ile Lys Cys Asn Leu
                165                 170                 175

Asn Ser Leu Ala Glu Val Ser Glu Gln Leu Ala Val Glu Ser Pro Thr
                180                 185                 190

Ser Leu Ile Asp Gln
                195
```

PYL-E V89Y E149L                                                (SEQ ID NO: 392)

```
Met Val Gly Leu Val Gly Gly Ser Thr Ala Arg Ala Glu His Val Val
1               5                   10                  15

Ala Asn Ala Gly Gly Glu Ala Glu Tyr Val Arg Arg Met His Arg His
                20                  25                  30

Ala Pro Thr Glu His Gln Cys Thr Ser Thr Leu Val Lys His Ile Lys
                35                  40                  45

Ala Pro Val His Leu Val Trp Glu Leu Val Arg Arg Phe Asp Gln Pro
50                  55                  60

Gln Arg Tyr Lys Pro Phe Val Arg Asn Cys Val Val Arg Gly Asp Gln
65                  70                  75                  80

Leu Glu Val Gly Ser Leu Arg Asp Tyr Asn Val Lys Thr Gly Leu Pro
                        85                  90                  95

Ala Thr Thr Ser Thr Glu Arg Leu Glu Gln Leu Asp Asp Asp Leu His
                100                 105                 110

Ile Leu Gly Val Lys Phe Val Gly Gly Asp His Arg Leu Gln Asn Tyr
                115                 120                 125

Ser Ser Ile Ile Thr Val His Pro Glu Ser Ile Asp Gly Arg Pro Gly
                130                 135                 140

Thr Leu Val Ile Leu Ser Phe Val Val Asp Val Pro Asp Gly Asn Thr
145                 150                 155                 160

Lys Asp Glu Thr Cys Tyr Phe Val Glu Ala Val Ile Lys Cys Asn Leu
                165                 170                 175

Asn Ser Leu Ala Glu Val Ser Glu Gln Leu Ala Val Glu Ser Pro Thr
                180                 185                 190

Ser Leu Ile Asp Gln
                195
```

ODN-ZmPYL-Dc                                                    (SEQ ID NO: 398)
AGGTC ATCGA CGGCC GGCCA GGGAC GCTCG TCATC CTGTC ATTCG TCGTC GACGT CCCCG ACGGC
AACAC CAAGG

ODN-ZmPYL-Dd-NT                                                 (SEQ ID NO: 399)
CCTTG GTGTT GCCGT CGGGG ACGTC GACGA CGAAT GACAG GATGA CGAGC GTCCC TGGCC GGCCG
TCGAT GACCT

ODN-ZmPYL-Dd-NT-PM
* denotes phosphorothioate modification
                                                                (SEQ ID NO: 400)
C*C*T*T GGTGT TGCCG TCGGG GACGT CGACG ACGAA TGACA GGATG ACGAG CGTCC CTGGC -continued

```
CGGCC GTCGA TGA*C*C *T

ODN-ZmPYL-Db
                                                                     (SEQ ID NO: 401)
CCATC CTCAC CGTCC ACCCG GAGGT CATCG ACGGC CGACC AGGGA CGCTC GTCAT CCTGT CCTTC
GTCGT CGACG TCCCC GACGG CAA

ODN-ZmPYL-Fa
                                                                     (SEQ ID NO: 402)
CGACG GCCGA CCGGG GACGC TCGTG ATCCT GTCCT TCGTG GTGGA CGTCC CCGAC GGCAA

ODN-ZmPYL-Fb
                                                                     (SEQ ID NO: 403)
CGACG GCCGA CCGGG GACGC TCGTG ATCCT GTCCT TCGTA GTGGA CGTCC CCGAC GGCAA

ODN-ZmPYL-Fc
                                                                     (SEQ ID NO: 404)
AGGTC ATCGA CGGCC GACCG GGGAC GCTCG TGATC CTGTC CTTCG TAGTG GACGT CCCCG ACGGC
AACAC CAAGG AC

ODN-ZmPYL-Fd-NT
                                                                     (SEQ ID NO: 405)
GTCCT TGGTG TTGCC GTCGG GGACG TCCAC TACGA AGGAC AGGAT CACGA GCGTC CCCGG TCGGC
CGTCG ATGAC CT

ODN-ZmPYL-Fd-NT-PM
* denotes phosphorothioate modification
                                                                     (SEQ ID NO: 406)
G*T*C*CT TGGTG TTGCC GTCGG GGACG TCCAC TACGA AGGAC AGGAT CACGA GCGTC CCCGG
TCGGC CGTCG ATGA*C* C*T ODN-ZmPYL-Jc short
                                                                     (SEQ ID NO: 407)
CACCG AGTTC CAGCC GGGCC CCTAC TGCGT CGTGC TCCTG TCCTA CGTCG TCGAC GTCCC CGACG
GCA ODN-ZmPYL-Jc short-NT
                                                                     (SEQ ID NO: 408)
TGCCG TCGGG GACGT CGACG ACGTA GGACA GGAGC ACGAC GCAGT AGGGG CCCGG CTGGA ACTCG
GTG ODN-ZmPYL-Jc short-NT-PM
* denotes phosphorothioate modification
                                                                     (SEQ ID NO: 409)
T*G*C*CG TCGGG GACGT CGACG ACGTA GGACA GGAGC ACGAC GCAGT AGGGG CCCGG CTGGA
ACTCG *G*T*G ODN-ZmPYL-Jc long
                                                                     (SEQ ID NO: 410)
TCACC TCCGT CACCG AGTTC CAGCC GGGCC CCTAC TGCGT CGTGC TCCTG TCCTA CGTCG TCGAC
GTCCC CGACG GCAAC ACCGA GGA
```

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

SEQUENCE LISTING (433 sequences)

SEQ ID NO: 1 - protein, 191 aa, Arabidopsis thaliana
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLESYVVDMPEGNSEDDTRMFADTVVKLNLQKLATVAEAMARNSGDGSGSQVT

SEQ ID NO: 2 - protein, 221 aa, Arabidopsis thaliana
MANSESSSSPVNEEENSQRISTLHHQTMPSDLTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNRNNNNNNSSQVR

SEQ ID NO: 3 - protein, 190 aa, Arabidopsis thaliana
MSSSPAVKGLTDEEQKTLEPVIKTYHQFEPDPTTCTSLITQRIHAPASVVWPLIRRFDNPERYKHFVKRCRLISGDGDVGSVREVTVISGLPASTSTERLEFVDDDHRVLSFRVVGGEHRLKNYKSVTSVNEFLNQDSGKVYTVVLESYTVDIPEGNTEEDTKMFVDTVVKLNLQKLGVAATSAPMHDDE

SEQ ID NO: 4 - protein, 209 aa, Arabidopsis thaliana
MNLAPIHDPSSSSTTTTSSSTPYGLTKDEFSTLDSIIRTHHTFPRSPNTCTSLIAHRVDAPAHAIWRFVRDFANPNKYKHFIKSCTIRVNGNGIKEIKVGTIREVSVVSGLPASTSVEILEVLDEEKRILSFRVLGGEHRLNNYRSVTSVNEFVVLEKDKKKRVYSVVLESYIVDIPQGNTEEDTRMFVDTVVKSNLQNLAVISTASPT

SEQ ID NO: 5 - protein, 207 aa, Arabidopsis thaliana
MLAVHRPSSAVSDGDSVQIPMMIASFQKRFPSLSRDSTAARFHTHEVGPNQCCSAVIQEISAPISTVWSVVRRFDNPQAYKHFLKSCSVIGGDGDNVGSLRQVHVVSGLPAASSTERLDILDDERHVISFSVVGGDHRLSNYRSVTTLHPSPISGTVVVESYVVDVPPGNTKEETCDFVDVIVRCNLQSLAKIAENTAAESKKKMSL

SEQ ID NO: 6 - protein, 203 aa, Arabidopsis thaliana
MRSPVQLQHGSDATNGFHTLQPHDQTDGPIKRVCLTRGMHVPEHVAMHHTHDVGPDQCCSSVVQMIHAPPESVWALVRRFDNPKVYKNFIRQCRIVQGDGLHVGDLREVMVVSGLPAVSSTERLEILDEERHVISFSVVGGDHRLKNYRSVTTLHASDDEGTVVVESYIVDVPPGNTEEETLSFVDTIVRCNLQSLARSTNRQ

SEQ ID NO: 7 - protein, 215 aa, Arabidopsis thaliana
MPTSIQFQRSSTAAEAANATVRNYPHHHQKQVQKVSLTRGMADVPEHVELSHTHVVGPSQCFSVVVQDVEAPVSTVWSILSRFEHPQAYKHFVKSCHVVIGDGREVGSVREVRVVSGLPAAFSLERLEIMDDDRHVISFSVVGGDHRLMNYKSVTTVHESEEDSDGKKRTRVVESYVVDVPAGNDKEETCSFADTIVRCNLQSLAKLAENTSKFS

SEQ ID NO: 8 - protein, 211 aa, Arabidopsis thaliana
MEMIGGDDTDTEMYGALVTAQSLRLRHLHHCRENQCTSVLVKYIQAPVHLVWSLVRRFDQPQKYKPFISRCTVNGDPEIGCLREVNVKSGLPATTSTERLEQLDDEEHILGINIIGGDHRLKNYSSILTVHPEMIDGRSGTMVMESFVVDVPQGNTKDDTCYFVESLIKCNLKSLACVSERLAAQDITNSIATFCNASNGYREKNHTETNL

SEQ ID NO: 9 - protein, 188 aa, Arabidopsis thaliana
MEANGIENLTNPNQEREFIRRHHKHELVDNQCSSTLVKHINAPVHIVWSLVRRFDQPQKYKPFISRCVVKGNMEIGTVREVDVKSGLPATRSTERLELLDDNEHILSIRIVGGDHRLKNYSSIISLHPETIEGRIGTLVIESFVVDVPEGNTKDETCYFVEALIKCNLKSLADISERLAVQDTTESRV

SEQ ID NO: 10 - protein, 187 aa, Arabidopsis thaliana
MMDGVEGGTAMYGGLETVQYVRTHHQHLCRENQCTSALVKHIKAPLHLVWSLVRRFDQPQKYKPFVSRCTVIGDPEIGSLREVNVKSGLPATTSTERLELLDDEEHILGIKIIGGDHRLKNYSSILTVHPEIIEGRAGTMVIESFVVDVPQGNTKDETCYFVEALIRCNLKSLADVSERLASQDITQ

SEQ ID NO: 11 - protein, 183 aa, Arabidopsis thaliana
MNGDETKKVESEYIKKHHRHELVESQCSSTLVKHIKAPLHLVWSIVRRFDEPQKYKPFISRCVVQGKKLEVGSVREVDLKSGLPATKSTEVLEILDDNEHILGIRIVGGDHRLKNYSSTISLHSETIDGKTGTLAIESFVVDVPEGNTKEETCFFVEALIQCNLNSLADVTERLQAESMEKKI

SEQ ID NO: 12 - protein, 161 aa, Arabidopsis thaliana
METSQKYHTCGSTLVQTIDAPLSLVWSILRRFDNPQAYKQFVKTCNLSSGDGGEGSVREVTVVSGLPAEFSRERLDELDDESHVMMISIIGGDHRLVNYRSKTMAFVAADTEEKTVVVESYVVDVPEGNSEEETTSFADTIVGFNLKSLAKLSERVAHLKL

SEQ ID NO: 13 - protein, 159 aa, Arabidopsis thaliana
MKTSQEQHVCGSTVVQTINAPLPLVWSILRRFDNPKTFKHFVKTCKLRSGDGGEGSVREVTVVSDLPASFSLERLDELDDESHVMVISIIGGDHRLVNYQSKTTVFVAAEEEKTVVVESYVVDVPEGNTEEETTLFADTIVGCNLRSLAKLSEKMMELT

SEQ ID NO: 14 - protein, 164 aa, Arabidopsis thaliana
MESSKQKRCRSSVVETIEAPLPLVWSILRSFDKPQAYQRFVKSCTMRSGGGGGKGGEGKGSVRDVTLVSGFPADFSTERLEELDDESHVMVVSIIGGNHRLVNYKSKTKVVASPEDMAKKTVVVESYVVDVPEGTSEEDTIFFVDNIIRYNLTSLAKLTKKMMK

SEQ ID NO: 15 - protein, 191 aa, Brassica oleracea
MPSQLTPEERSELAQSIAEFHTYHLGPGSCSSLHAQRIHAPPEIVWSVVRRFDKPQTYKHFIKSCSVEDGFEMRVGCTRAVNVISGLPANTSTERLDILDDERRVTGFSIIGGEHRLTNYKSVTTVHRFEKERRIWTVVLESYVVDMPEGNSEDDTRMFADTVVKLNLQKLATVTEAMARNAGDGSGAQVT

SEQ ID NO: 16 - protein, 281 aa, Brassica oleracea
MPSELTQEERSKLTQSISEFHTYHLGPGSCSSLHAQRIHAPPEIVWSVVRQFDKPQTYKHFIKSCSVEEGFEMRVGCTRDVIVISGLPANTSTERLDMLDDERRVTGFSIIGGEHRLKNYKSVTTVHRFERERRIWTVVLESYVVDMPEGNSEDDTRMFADTVVKLNLQKLATVTEAMARNAGDGRGSRETTCRESFHLITAFEKQRQITEPTVYQNPPYHTGMTPEPRTSTVFIELEDHRTLPGNLTPTTEEHLQRMYQRFWGIRQLQRPRQSFGERQSI

SEQ ID NO: 17 - protein, 453 aa, Vitis vinifera
MQMKYLEGKQNLMEEKGEKQCIPMDLAVREAQFKGSLLDRITWLEQRLHKLSLQLETRSKQQPHPSRMQTAGETSSRHGPKKELSCSFPVFSTRNHNHGHKQTSQFHVPRFEYQEGGRENPAVVITKLTPFHHPKIITILFPISNYFIIFFFLTFDTKKQYPLLFPILPSRFLPISHLITQEIEKYKTSSHFSSPASLFAAMNKAETSSMAEAESEDSETTTPTTHHLTIPPGLTQPEFQELAHSISEFHTYQVGPGQCSSLLAQRVHAPLPTVWSVVRRFDKPQTYKHFIKSCHVEDGFEMRVGCLRDVNVISGLPAETSTERLDILDDERHVTGFSIIGGEHRLRNYRSVTTNHGGEIWTVVLESYVVDMPEGNTEEDTRLFADTVVKLNLQKLASVTEVSQSCNYPCQFHIIENEDIQPEEMNLGVLTTSIEEQRKKKRVVAMKDGSTSS

SEQ ID NO: 18 - protein, 195 aa, Vitis vinifera
  VARIANT (193)..(193): Xaa = any amino acid
MAEAESEDSETTTPTTHHLTIPPGLTQPEFQELAHSISEFHTYQVGPGQCSSLLAQRVHAPLPTVWSVVRRFDKPQTYKHFIKSCHVEDGFEMRVGCLRDVNVISGLPAETSTERLDILDDERHVTGFSIIGGEHRLRNYRSVTTVHEYQNHGGEIWTVVLESYVVDMPEGNTEEDTRLFADTVVKLNLSEAXRR

SEQ ID NO: 19 - protein, 217 aa, Medicago truncatula
  MISC_FEATURE (1)..(217)
MEKAESSTASTSDQDSDENHRTQHHLTLPSGLRQHEFDSLIPFINSHHTYLIGPNQCSTLLAQRIHAPPQTVWSVVRSFDKPQIYKHIIKSCSLKEGFQMKVGCTRDVNVISGLPAATSTERLDVLDDERRVTGFSIIGGEHRLKNYRSVTSVHGFGDGDNGGEIWTVVLESYVVDVPEGNTEEDTRLFADTVVKLNLQKLASVTEGKNRDGDGKSH

SEQ ID NO: 20 - protein, 212 aa, Oryza sativa
MEQQEEVPPPPAGLGLTAEEYAQVRATVEAHHRYAVGPGQCSSLLAQRIHAPPAAVWAVVRRFDCPQVYKHFIRSCVLRPDPHHDDNGNDLRPGRLREVSVISGLPASTSTERLDLLDDAHRVFGFTITGGEHRLRNYRSVTTVSQLDEICTLVLESYIVDVPDGNTEDDTRLFADTVIRLNLQKLKSVSEANANAAAAAAAPPPPPPAAAE

SEQ ID NO: 21 - protein, 212 aa, Zea mays
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELAVPAICTVVLESYVVDVPDGNTEDDTRLFADTVIRLNLQKLKSVAEANAAEAAATTNSVLLPRPAE

SEQ ID NO: 22 - protein, 212 aa, Zea mays
  VARIANT (11)..(11): Xaa = any amino acid
MDQQGAGGDAXVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLESYVVDVPDGNTEDDTRLFADTVIRLNLQKLKSVTEANAAEAAATTNSVLLPRPAE

SEQ ID NO: 23 - protein, 233 aa, Vitis vinifera
MDPHHHHGLTEEEFRALEPIIQNYHTFEPSPNTCTSLITQKIDAPAQVVWPFVRSFENPQKYKHFIKDCTMRGDGGVGSIREVTVVSGLPASTSTERLEILDDEKHILSFRVVGGEHRLNNYRSVTSVNDFSKEGKDYTIVLESYIVDIPEGNTGEDTKMFVDTVVKLNLQKLAVVAITSLHENEEIADNEGPSREISLQSETESAERGDERRDGDGPSKACNRNEWHCTTKE

SEQ ID NO: 24 - protein, 207 aa, Oryza sativa
MEPHMERALREAVASEAERRELEGVVRAHHTFPAAERAAGPGRRPTCTSLVAQRVDAPLAAVWPIVRGFANPQRYKHFIKSCELAAGDGATVGSVREVAVVSGLPASTSTERLEILDDDRHVLSFRVVGGDHRLRNYRSVTSVTEFSSPSSPPRPYCVVVESYVVDVPEGNTEEDTRMFTDTVVKLNLQKLAAVATSSSPPAAGNHH

SEQ ID NO: 25 - protein, 210 aa, Oryza sativa
MEPHMERALREAVASEAERRELEGVVRAHHTFPAAERAAGPGRRPTCTSLVAQRVDAPLAAVWPIVRGFANPQRYKHFIKSCELAAGDGATVGSVREVAVVSGLPASTSTERLEILDDDRHVLSFRVVGGDHRLRNYRSVTSVTEFSSPSSPPSPPRPYCVVVESYVVDVPEGNTEEDTRMFTDTVVKLNLQKLAAVATSSSPPAAGNHH

SEQ ID NO: 26 - protein, 200 aa, Zea mays
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVESYVVDVPHGNTADETRVFVDTIVRCNLQSLARTAERLA

SEQ ID NO: 27 - protein, 215 aa, Vitis vinifera
MPSNPPKSSLVVHRINSPNSITTATTASAAANNHNTSTMPPHKQVPDAVSRHHTHVVGPNQCCSAVVQQIAAPVSTVWSVVRRFDNPQAYKHFVKSCHVVVGDGDVGTLREVHVISGLPAANSTERLEILDDERHVLSFSVIGGDHRLSNYRSVTTLHPSPSSTGTVVLESYVVDIPPGNTKEDTCVFVDTIVRCNLQSLAQIAENAAGCKRSSS

SEQ ID NO: 28 - protein, 213 aa, Nicotiana tabacum
MPPSSPDSSVLLQRISSNTTPDFACKQSQQLQRRTMPIPCTTQVPDSVVRFHTHPVGPNQCCSAVIQRISAPVSTVWSVVRRFDNPQAYKHFVKSCHVIVGDGDVGTLREVRVISGLPAASSTERLEILDDERHVISFSVVGGDHRLANYRSVTTLHPEPSGDGTTIVVESYVVDVPPGNTRDETCVFVDTIVKCNLTSLSQIAVNVNRRKDS

SEQ ID NO: 29 - protein, 208 aa, Oryza sativa
MPYAAVRPSPPPQLSRPIGSGAGGGKACPAVPCEVARYHEHAVGAGQCCSTVVQAIAAPADAVWSVVRRFDRPQAYKKFIKSCRLVDGDGGEVGSVREVRVVSGLPATSSRERLEVLDDDRRVLSFRIVGGEHRLANYRSVTTVHEAAAPAMAVVVESYVVDVPPGNTWEETRVFVDTIVRCNLQSLARTVERLAPEAPRANGSIDHA

SEQ ID NO: 30 - protein, 208 aa, Oryza sativa
MPYAAVRPSPPPQLSRPIGSGAGGGKACPAVPCEVARYHEHAVGAGQCFSTVVQAIAAPADAVWSVVRRFDRPQAYKKFIKSCRLVDGDGGEVGSVREVRVVSGLPATSSRERLEVLDDDRRVLSFRIVGGEHRLANYRSVTTVHEAAAPAMAVVVESYVVDVPPGNTWEETRVFVDTIVRCNLQSLARTVERLAPEAPRANGSIDHA

SEQ ID NO: 31 - protein, 213 aa, Picea sitchensis
MDIIAGFDQLSFRLSGASKQITKTGAVQYLKGEEGYGEWLKEVMGRYHYHSHDGARECRCSSVVVQQVEAPVSVVWSLVRRFDQPQVYKHFVSNCFMRGDLKVGCLREVRVVSGLPAATSTERLDILDEERHILSFSIVGGDHRLNNYRSITTLHETLINGKPGTIVIESYVLDVPHGNTKEETCLFVDTIVKCNLQSLAHVSNHLNSTHRCL

SEQ ID NO: 32 - protein, 207 aa, Oryza sativa
MEAHVERALREGLTEEERAALEPAVMAHHTFPPSTTTATTAAATCTSLVTQRVAAPVRAVWPIVRSFGNPQRYKHFVRTCALAAGDGASVGSVREVTVVSGLPASTSTERLEMLDDDRHIISFRVVGGQHRLRNYRSVTSVTEFQPPAAGPGPAPPYCVVVESYVVDVPDGNTAEDTRMFTDTVVKLNLQMLAAVAEDSSSASRRRD

SEQ ID NO: 33 - protein, 216 aa, Oryza sativa
MPYTAPRPSPPQHSRIGGCGGGGVLKAAGAAGHAASCVAVPAEVARHHEHAAGVGQCCSAVVQAIAAPVDAVWSVVRRFDRPQAYKHFIRSCRLLDGDGDGGAVAVGSVREVRVVSGLPATSSRERLEILDDERRVLSFRVVGGEHRLSNYRSVTTVHETAAGAAAAVVVESYVVDVPHGNTADETRMFVDTIVRCNLQSLARTAEQLALAAPRAA

SEQ ID NO: 34 - protein, 212 aa, Vitis vinifera
MPSSLQLHRINNIDPTTVAVAATAAVNCHKQSRTPLRCATPVPDAVASYHAHAVGPHQCCSMVVQTTAAALPTVWSVVRRFDNPQAYKHFLKSCHVIFGDGDIGTLREVHVVSGLPAESSTERLEILDDERHVLSFSVVGGDHRLCNYRSVTTLHPSPTGTGTVVVESYVVDIPPGNTKEDTCVFVDTIVKCNLQSLAQMSEKLTNNNRNSS

SEQ ID NO: 35 - protein, 218 aa, Zea mays
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVESYVVDVPPGNTPEDTRVFVDTIVKCNLQSLATTAEKLALAAV

SEQ ID NO: 36 - protein, 179 aa, Physcomitrella patens
MQTKGRQADFQTLLEGQQDLICRFHRHELQPHQCGSILLQLIKAPVETVWSVARSFDKPQVYKRFIQTCEIIEGDGGVGSIREVRLVSSIPATSSIERLEILDDEEHIISFRVLGGGHRLQNYWSVTSLHSHEIDGQMGTLVLESYVVDIPEGNTREETHMFVDTVVRCNLKALAQVSE

SEQ ID NO: 37 - protein, 229 aa, Oryza sativa
MPCIPASSPGIPHQHQHQHHRALAGVGMAVGCAAEAAVAAAGVAGTRCGAHDGEVPMEVARHHEHAEPGSGRCCSAVVQHVAAPAPAVWSVVRRFDQPQAYKRFVRSCALLAGDGGVGTLREVRVVSGLPAASSRERLEILDDESHVLSFRVVGGEHRLKNYLSVTTVHPSPSAPTAATVVVESYVVDVPPGNTPEDTRVFVDTIVKCNLQSLAKTAEKLAAGARAAGS

SEQ ID NO: 38 - protein, 229 aa, Oryza sativa
MPCIPASSPGIPHQHQHQHHRALAGVGMAVGCAAEAAVAAAGVAGTRCGAHDGEVPMEVARHHEHAEPGSGRCCSAVVQHVAAPAAAVWSVVRRFDQPQAYKRFVRSCALLAGDGGVGTLREVRVVSGLPAASSRERLEILDDESHVLSFRVVGGEHRLKNYLSVTTVHPSPSAPTAATVVVESYVVDVPPGNTPEDTRVFVDTIVKCNLQSLAKTAEKLAAGARAAGS

SEQ ID NO: 39 - protein, 205 aa, Medicago truncatula
MPSPVQFQRFDSNTAITNGVNCPKQIQACRYALSSLKPTVSVPETVVDHHMHVVGQNQCYSVVIQTINASVSTVWSVVRRFDYPQGYKHFVKSCNVVASGDGIRVGALREVRLVSGLPAVSSTERLDILDEERHVISFSVVGGVHRCRNYRSVTTLHGDGNGGTVVIESYVVDVPQGNTKEETCSFADTIVRCNLQSLVQIAEKL

SEQ ID NO: 40 - protein, 212 aa, Zea mays
MPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVESYVVDVPPGNTVEETRIFVDTIVRCNLQSLEGTVIRQLEIAAMPHDDNQN

SEQ ID NO: 41 - protein, 233 aa, Zea mays
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVESYVVDVPPGNTVEETRIFVDTIVRCNLQSLEGTVIRQLEIAAMPHDDNQN

SEQ ID NO: 42 - protein, 194 aa, Physcomitrella patens
MMQEKQGRPDFQFLLEGQQDLICRFHKHELLPHQCGSILLQQIKAPVQTVWLIVRRFDEPQVYKRFIQRCDIVEGDGVVGSIREVQLVSSIPATSSIERLEILDDEEHIISFRVLGGGHRLQNYWSVTSLHRHEIQGQMGTLVLESYVVDIPDGNTREETHTFVDTVVRCNLKALAQVSEQKHLLNSNEKPAAP

SEQ ID NO: 43 - protein, 191 aa, Vitis vinifera
MKVYSPSQILAERGPRAQAMGNLYHTHHLLPNQCSSLVVQTTDAPLPQVWSMVRRFDRPQSYKRFVRGCTLRRGKGGVGSVREVNIVSGLPAEISLERLDKLDDDLHVMRFTVIGGDHRLANYHSTLTLHEDEEDGVRKTVVMESYVVDVPGGNSAGETCYFANTIIGFNLKALAAVTETMALKANIPSGF

SEQ ID NO: 44 - protein, 217 aa, Physcomitrella patens
MQQVKGRQDFQRLLEAQQDLICRYHTHELKAHQCGSILLQQIKVPLPIVWAIVRSFDKPQVYKRFIQTCKITEGDGGVGSIREVHLVSSVPATCSIERLEILDDEKHIISFRVLGGGHRLQNYSSVSSLHELEVEGHPCTLVLESYMVDIPDGNTREETHMFVDTVVRCNLKSLAQISEQQYNKDCLQQKQHDQQQMYQQRHPPLPPIPITDKNMER

SEQ ID NO: 45 - protein, 195 aa, Physcomitrella patens
MRFDIGHNDVRGFFTCEEEHAYALHSQTVELNQCGSILMQQIHAPIEVVWSIVRSFGSPQIYKKFIQACILTVGDGGVGSIREVFLVSGVPATSSIERLEILDDEKHVFSFRVLKGGHRLQNYRSVTTLHEQEVNGRQTTTVLESYVVDVPDGNTREETHMFADTVVMCNLKSLAQVAEWRAMQGITQQLSTSSL

SEQ ID NO: 46 - protein, 172 aa, Vitis vinifera
MGNLYHTHHLLPNQCSSLVVQTTDAPLPQVWSMVRRFDRPQSYKRFVRGCTLRRGKGGVGSVREVNIVSGLPAEISLERLDKLDDDLHVMRFTVIGGDHRLANYHSTLTLHEDEEDGVRKTVVMESYVVDVPGGNSAGETCYFANTIIGFNLKALAAVTETMALKANIPSGF

SEQ ID NO: 47 - protein, 196 aa, Picea sitchensis
MEDLSSWREGRAMWLGNPPSESELVCRHHRHELQGNQCSSFLVKHIRAPVHLVWSIVRTFDQPQKYKPFVHSCSVRGGITVGSIRNVNVKSGLPATASEERLEILDDNEHVFSIKILGGDHRLQNYSSIITVHPEIIDGRPGTLVIESYVVDVPEGNTREETRFFVEALVKCNLKSLADVSERLASQHHTELLERT

SEQ ID NO: 48 - protein, 185 aa, Solanum tuberosum
MNANGFCGVEKEYIRKHHLHEPKENQCSSFLVKHIRAPVHLVWSLVRRFDQPQKYKPFISRCIVQGDLEIGSLREVDVKSGLPATTSTERLELLDDEEHILSVRIVGGDHRLRNYSSVISVHPEVIDGRPGTVVLESFVVDVPEGNTKDETCYFVEALINCNLKSLADISERVAVQDRTEPIDQV

SEQ ID NO: 49 - protein, 190 aa, Medicago truncatula
MNNGCEQQQYSVIETQYIRRHHKHDLRDNQCSSALVKHIKAPVHLVWSLVRRFDQPQKYKPFISRCIMQGDLSIGSVREVNVKSGLPATTSTERLEQLDDEEHILGIRIVGGDHRLRNYSSIITVHPGVIDGRPGTMVIESFVVDVPEGNTKDETCYFVEALIRYNLSSLADVSERMAVQGRTDPININP

SEQ ID NO: 50 - protein, 185 aa, Vitis vinifera
MSGYGCIKMEDEYIRRHHRHEIRDNQCSSSLVKHIKAPVHLVWSLVRSFDQPQKYKPFVSRCIVQGDLEIGSVREVNVKSGLPATTSTERLELLDDEEHIFGMRIVGGDHRLKNYSSIVTVHPEIIDGRPGTLVIESFVVDVPDGNTKDETCYFVEALIKCNLKSLADVSERLAIQDRTEPIDRM

SEQ ID NO: 51 - protein, 185 aa, Vitis vinifera
MNGNGLSSMESEYIRRHHRHEPAENQCSSALVKHIKAPVPLVWSLVRRFDQPQKYKPFISRCVVQGNLEIGSLREVDVKSGLPATTSTERLELLDDDEHILSMRIIGGDHRLRNYSSIISLHPEIIDGRPGTMVIESYVVDVPEGNTKDETCYFVEALIKCNLKSLADVSERLAVQDRTEPIDRM

SEQ ID NO: 52 - protein, 208 aa, Oryza sativa
MEAHVERALREGLTEEERAALEPAVMAHHTFPPSTTTATTAAATCTSLVTQRVAAPVRAVWPIVRSFGNPQRYKHFVRTCALAAGNGPSFGSVREVTVVSGPSRLPPGTERLEMLDDDRHIISFRVVGGQHRLRNYRSVTSVTEFQPPAAGPGPAPPYCVVVESYVVDVPDGNTAEDTRMFTDTVVKLNLQMLAAVAEDSSSASRRRD

SEQ ID NO: 53 - protein, 186 aa, Capsicum annuum
MMNANGFSGVEKEYIRKHHLHQPKENQCSSFLVKHIRAPVHLVWSLVRRFDQPQKYKPFVSRCIAQGDLEIGSLREVDVKSGLPATTSTERLELLDDEEHILSFRIIGGDHRLRNYSSIISLHPEVIDGRPGTLVIESFVVDVPQGNTKDETCYFVEALINCNLKSLADVSERLAVQDRTEPIDQV

SEQ ID NO: 54 - protein, 186 aa, Populus trichocarpa
MNGSDAYSATEAQYVRRHHKHEPRENQCTSALVKHIKAPAHLVWSLVRRFDQPQRYKPFVSRCVMNGELGIGSVREVNVKSGLPATTSTERLELLDDEEHILGVQIVGGDHRLKNYSSIMTVHPEFIDGRPGTLVIESFIVDVPDGNTKDETCYFVEALIRCNLKSLADVSERMAVQDRVEPVNQF

SEQ ID NO: 55 - protein, 185 aa, Capsicum annuum
MNANGFSGVEKEYIRKHHLHQPKENQCSSFLVKHIRAPVHLVWSLVRRFDQPQKYKPFVSRCIAQGDLEIGSLREVDVKSGLPATTSTERLELLDDEEHILSFRIIGGDHRLRNYSSIISLHPEVIDGRPGTLVIESFVVDVPQGNTKDETCYFVEALINCNLKSLADVSERLAVQDRTEPIDQV

SEQ ID NO: 56 - protein, 186 aa, Populus trichocarpa x Populus deltoides
MNGSDAYSATEAQYVRRHHKHEPRENQCTSALVKHIKAPAHLVWSLVRRFDQPQRYKPFVSRCVMNGELGIGSVREVNVKSGLPATTSTERLELLDDEEHILGVQIVGGDHRLKNYSSIMTVHPEFIDGRPGTLVIESFIVDVPDGNTKDETCYFVKALIRCNLKSLADVSERMAVQDRVEPVNQF

SEQ ID NO: 57 - protein, 188 aa, Pisum sativum
MNNGGEQYSAIETQYIRRRHKHDLRDNQCSSALVKHIKAPVHLVWSLVRRFDQPQKYKPFVSRCIMQGDLGIGSVREVNVKSGLPATTSTERLEQLDDEEHILGIRIVGGDHRLRNYSSVITVHPEVIDGRPGTMVIESFVVDVPEGNTRDETCYFVEALIRGNLSSLADVSERMAVQGRTDPINVNP

SEQ ID NO: 58 - protein, 177 aa, Vitis vinifera
MEAQVICRHHAHEPRENQCSSVLVRHVKAPANLVWSLVRRFDQPQKYKPFVSRCVVQGDLRIGSVREVNVKTGLPATTSTERLELFDDDEHVLGIKILDGDHRLRNYSSVITVHPEIIDGRPGTLVIESFVVDVPEGNTKDDTCYFVRALINCNLKCLAEVSERMAMLGRVEPANAV

SEQ ID NO: 59 - protein, 178 aa, Vitis vinifera
MMEAQVICRHHAHEPRENQCSSVLVRHVKAPANLVWSLVRRFDQPQKYKPFVSRCVVQGDLRIGSVREVNVKTGLPATTSTERLELFDDDEHVLGIKILDGDHRLRNYSSVITVHPEIIDGRPGTLVIESFVVDVPEGNTKDDTCYFVRALINCNLKCLAEVSERMAMLGRVEPANAV

SEQ ID NO: 60 - protein, 193 aa, Arachis hypogaea
  VARIANT (162)..(162): Xaa = any amino acid
MMNGSCGGGGGGEAYGAIEAQYIRRHHRHEPRDNQCTSALVKHIRAPVHLVWSLVRRFDQPQKYKPFVSRCIMQGDLGIGSVREVNVKSGLPATTSTERLEQLDDEEHILGIRIVGGDHRLRNYSSIITVHPEVIEGRPGTMVIESFVVDVPDGNTKDETCXFVEALIRCNLSSLADVSERMAVQGRTDPINQ

SEQ ID NO: 61 - protein, 217 aa, Zea mays
MVVEMDGGVGVAAGGGGGAQTPAPAPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILTVHPEVIDGRPGTLVIESFVVDVPDGNTKDETCYFVEALLKCNLRSLAEVSEGQVIMDQTEPLDR

SEQ ID NO: 62 - protein, 217 aa, Zea mays
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILTVHPEVIDGRPGTLVIESFVVDVPDGNTKDETCYFVEALLKCNLRSLAEVSEGQVIMDQTEPLDR

SEQ ID NO: 63 - protein, 206 aa, Oryza sativa
MNGVGGAGGAAAGKLPMVSHRRVQWRLADERCELREEEMEYIRRFHRHEPSSNQCTSFAAKHIKAPLHTVWSLVRRFDQPQLFKPFVRNCVMRENIIATGCIREVNVQSGLPATRSTERLELLDDNEHILKVNFIGGDHMLKNYSSILTVHSEVIDGQLGTLVVESFIVDVPEGNTKDDISYFIENVLRCNLRTLADVSEERLANP

SEQ ID NO: 64 - protein, 206 aa, Oryza sativa
MNGAGGAGGAAAGKLPMVSHRQVQWRLADERCELREEEMEYIRQFHRHEPSSNQCTSFVAKHIKAPLQTVWSLVRRFDQPQLFKPFVRKCVMRENIIATGCVREVNVQSGLPATRSTERLELLDDNEHILKVKFIGGDHMLKNYSSILTIHSEVIDGQLGTLVVESFVVDIPEGNTKDDICYFIENILRCNLMTLADVSEERLANP

SEQ ID NO: 65 - protein, 205 aa, Oryza sativa
MVEVGGGAAEAAAGRRWRLADERCDLRAAETEYVRRFHRHEPRDHQCSSAVAKHIKAPVHLVWSLVRRFDQPQLFKPFVSRCEMKGNIEIGSVREVNVKSGLPATRSTERLELLDDNEHILSVRFVGGDHRLKNYSSILTVHPEVIDGRPGTLVIESFVVDVPEGNTKDETCYFVEALLKCNLKSLAEVSERLVCQGPNRAPSTR

SEQ ID NO: 66 - protein, 204 aa, Oryza sativa
MVEVGGGAAEAAAGRRWRLADERCDLRAAETEYVRRFHRHEPRDHQCSSAVAKHIKAPVHLVWSLVRRFDQPQLFKPFVSRCEMKGNIEIGSVREVNVKSGLPATRSTERLELLDDNEHILSVRFVGGDHRLKNYSSILTVHPEVIDGRPGTLVIESFVVDVPEGNTKDETCYFVEALLKCNLKSLAEVSERLVVKDQTEPLDR

SEQ ID NO: 67 - protein, 199 aa, Medicago truncatula
MEKMNGTENNGVFNSTEMEYIRRHHNQQPGENQCSSALVKHIRAPVPLVWSLVRRFDQPQKYKPFVSRCVVRGNLEIGSLREVDVKSGLPATTSTERLEVLDDNEHILSIRIIGGDHRLRNYSSIMSLHPEIIDGRPGTLVIESFVVDVPEGNTKDETCYFVEALIKCNLKSLSDVSEGHAVQDLTEPLDRVHELLISG

SEQ ID NO: 68 - protein, 199 aa, Medicago truncatula
MEKMNGTENNGVFNSTEMEYIRRHHNQQPGENQCSSALVKHIRAPVPLVWSLVRRFDQPQKYKPFVSRCVVRGNLEIGSLREVDVKSGLPATTSTERLEVLDDNEHILSIRIIGGDHRLRNYSSIMSLHPEIIDGRPGTLVIESFVVDVPEGNTKDETCYFVEALIKCNLKSLSDVSEGHAAQDLTEPLDRMHELLISG

SEQ ID NO: 69 - protein, 197 aa, Zea mays
MVGLVGGSTARAEHVVANAGGEAEYVRRMHRHAPTEHQCTSTLVKHIKAPVHLVWQLVRRFDQPQRYKPFVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFVEAVIKCNLNSLAEVSEQLAVESPTSLIDQ

SEQ ID NO: 70 - protein, 197 aa, Zea mays
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFVEAVIKCNLNSLAEVSEQLAVESPTSLIDQ

SEQ ID NO: 71 - protein, 212 aa, Zea mays
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILTVHPEVIDGRPGTLVIESFVVDVPDGNTKDETCYFVEALLKCNLKSLAEVSERQVVKDQTEPLDR

SEQ ID NO: 72 - protein, 205 aa, Oryza sativa
MNGAGGAGGAAAGKLPMVSHRRVQCRLADKRCELREEEMEYIRQFHRHEPSSNQCTSFVAKHIKAPLQTVWSLVRRFDQPQLFKPFVRKCVMRENIIVTGCVREVNVQSGLPATRSTERLELLDDNEHILKVKFIGGDHMLKNYSSILTIHSEVIDGQLGTLVVESFVVDIPDGNTKDDICYFIENVLRCNLMTLADVSEERLAN

SEQ ID NO: 73 - protein, 197 aa, Zea mays
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFVEAVIKCNLKSLAEVSEQLAVESPTSPIDQ

SEQ ID NO: 74 - protein, 206 aa, Oryza sativa
MNGVGGAGGAAAGKLPMVSHRRVQWRLADERCELREEEMEYIRRFHRHEPSSNQCTSFAAKHIKAPLHTVWSLVRRFDQPQLFKPFVRNCVMRENIIATGCIREVNVQSGLPATRSTERLELLDDNEHILKVKFIGGDHMLKNYSSILTVHSEVIDGQLGTLVVESFIVDVLEGNTKDDISYFIENVLRCNLRTLADVSEERLANP

SEQ ID NO: 75 - protein, 209 aa, Oryza sativa
MVGLVGGGGWRVGDDAAGGGGGGAVAAGAAAAAEAEHMRRLHSHAPGEHQCSSALVKHIKAPVHLVWSLVRSFDQPQRYKPFVSRCVVRGGDLEIGSVREVNVKTGLPATTSTERLELLDDDEHILSVKFVGGDHRLRNYSSIVTVHPESIDGRPGTLVIESFVVDVPDGNTKDETCYFVEAVIKCNLTSLAEVSERLAVQSPTSPLEQ

SEQ ID NO: 76 - protein, 180 aa, Oryza sativa
MVEMDAGGRPEPSPPSGQCSSAVTMRINAPVHLVWSIVRRFEEPHIFQPFVRGCTMRGSTSLAVGCVREVDFKSGFPAKSSVERLEILDDKEHVFGVRIIGGDHRLKNYSSVLTAKPEVIDGEPATLVSESFVVDVPEGNTADETRHFVEFLIRCNLRSLAMVSQRLLLAQGDLAEPPAQ

SEQ ID NO: 77 - protein, 176 aa, Vitis vinifera
MNGNGLSSMESEYIRRHHRHEPAENQCSSALVKHIKAPVPLVWSLVRRFDQPQKYKPFISRCVVQGNLEIGSLREVDVKSGLPATTSTERLELLDDDEHILSMRIIGGDHRLRNYSSIISLHPEIIDGRPGTMVIESYVVDVPEGNTKDETCYFSLADVSERLAVAGTVTEPIDRM

SEQ ID NO: 78 - protein, 180 aa, Oryza sativa
MVEMDAGGRPEPSPPSGQCSSAVTMRINAPVHLVWSIVRRFEEPHIFQPFVRGCTMRGSTSLAVGCVREVDFKSGFSAKSSVERLEILDDKEHVFGVRIIGGDHRLKNYSSVLTAKPEVIDGEPATLVSESFVIDVPEGNTADETRHFVEFLIRCNLRSLAMVSQRLLLAQGDLAEPPAQ

SEQ ID NO: 79 - protein, 215 aa, Oryza sativa
MPCIPASSPGIPHQHQHQHHRALAGVGMAVGCAAEAAVAAAGVAGTRCGAHDGEVPMEVARHHEHAEPGSGRCCSAVVQHVAAPAAAVWSVVRRFDQPQAYKRFVRSCALLAGDGGLGKVRERLEILDDESHVLSFRVVGGEHRLKNYLSVTTVHPSPSAPTAATVVVESYVVDVPPGNTPEDTRVFVDTIVKCNLQSLAKTAEKLAAGARAAGS

SEQ ID NO: 80 - protein, 186 aa, Rheum australe
MNGDGYGGSEEEFVKRYHEHVLADHQCSSVLVEHINAPLHLVWSLVRSFDQPQKYKPFVSRCVVQGGDLEIGSVREVDVKSGLPATTSMEELELLDDKEHVLRVKFVGGDHRLKNYSSIVSLHPEIIGGRSGTMVIESFIVDIADGNTKEETCYFIESLINCNLKSLSCVSERLAVEDIAERIAQM

SEQ ID NO: 81 - protein, 254 aa, Oryza sativa
MVGLVGGGGWRVGDDAAGGGGGGAVAAGAAAAAEAEHMRRLHSQGPRRAPVQLRARQAHQGSCSPPRIECANFAVFLAARDPKIVWSLVRSFDQPQRYKPFVSRCVVRGGDLEIGSVREVNVKTGLPATTSTERLELLDDDEHILSVKFVGGDHRLRNYSSIVTVHPESIDGRPGTLVIESFVVDVPDGNTKDETCYFVEAVIKCNLTSLAEMVRMISLVLPFMLVDRMSGITCESHLETTLVRCGEYAVLAHV

SEQ ID NO: 82 - protein, 186 aa, Oryza sativa
MEPHMERALREAVASEAERRELEGVVRAHHTGWNAPLAAVWPHRARVRPTRSGTSTSSSRASSPPGDGATVGSVREVAVVSGLPASTSTERLEILDDDRHVLSFRVVGGDHRLRNYRSVTSVTEFSSPSSPPRPYCVVVESYVVDVPEGNTEEDTRMFTDTVVKLNLQKLAAVATSSSPPAAGNHH

SEQ ID NO: 83 - protein, 150 aa, Oryza sativa
MEVVWSIVRRFEEPHIFQPFVRGCTMRGSTSLAVGCVREVDFKSGFPAKSSVERLEILDDKEHVFGVRIIGGDHRLKNYSSVLTAKPEVIDGEPATLVSESFVVDVPEGNTADETRHFVEFLIRCNLRSLAMVSQRLLLAQGDLAEPPGQ

SEQ ID NO: 84 - protein, 206 aa, Oryza sativa
MPYTAPRPSPPQHSRIGGCGGGGVLKAAGAAGHAASCVAVPAEVARHHEHAAGVGQCCSAVVQAIAAPVDAVWRTSTSSGAAASWTATATAGPLPVGSVREFRVLSGLPGTSSRERLEILDDERRVLSFRVVGGEHRLSNYRSVTTVHETAAGAAAAVVVESYVVDVPHGNTADETRMFVDTIVRCNLQSLARTAEQLALAAPRAA

SEQ ID NO: 85 - protein, 396 aa, Vitis vinifera
  VARIANT (1)..(396): Xaa = any amino acid
MPISSLPFSLYTVTPNPLKLITTHAHAFTPHTHIFTLKFMSHTYCPHIHHITSIHYTHLLXPIPHMPLQPPLPPHPILPSMPAFQHLYSTNQHLQVALFSARGPNIRDFNFQDADLLKLDILAPGSLIWAAWSPNGTDEANYVGEGSPTVAMIAKRGPRHGKYMAFCXMYRDNVAPKGVNXAVATVKTKRTIQLKTSLEIACHYAGINISGINGEVMPGQWEYQVGPGQCSSLLAQRVHVPLSAVGSVVHRFDKPQRYQHVIKSCRIEDGFEMRMGXLRDVNIISGLPTATNTGRLDMQDDERHVTRCPHQRQSESKYTENNNSDASSIKSPINGPSEHLKTAASPKTESIIVIDTSKFLNEEDFEGKDETSSSNQVQIEDENWETRFPNTDAGIW

SEQ ID NO: 86 - protein, 443 aa, Vitis vinifera
  VARIANT (1)..(443): Xaa = any amino acid
MPSAXKSSTVPLSLXQFKLGLRHGHRVIPWGDLDSLAMLQRQLDVDILVTGHTHRFTAYKHEGGVVINPGSATGAFGSITYDVNPSFVLMDIDGLRVVVCVYELIDETANIIKELHARKISFGTKSMIXCLLLKRRSTPKFRRKKLFLFQCRVQMTLTLTNLAVSGIAQTLQVDQWTVCALIFMTRRDIHLDKARFLDFKDMGKLLADASGLRKALSGGXVTAGMAIFDTMRHIRPDVPTVCVGLAAVAMIAKRGPRHGKYMAFCPMYRDNVAPKGVNVAVVTVKTKRTIQLKTSLEIACHYAGINISGINGEVMPGQWEYQVGPGQCSSLLAQRVHVPLSAVGSVVHRFDKPQRYQHVIKSCRIEDGFEMRMGRLRDVNIISGLPTATNTGRLDMQDDEXHVTRCPHQRQSESKYTENNNSDASSVKSPINGPSEHLKTAAX

SEQ ID NO: 87 - protein, 95 aa, Oryza sativa
EIGSVREVNVKTGLPATTSTERLELLDDDEHILSVKFVGGDHRLRNYSSIVTVHPESIDGRPGTLVIESFVVDVPDGNTKDETCYFVEAVIKCNL

SEQ ID NO: 88 - protein, 191 aa, Zea mays
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQVCSVLHLSIFCAAHARYFAHHLKCVLEFLCQMHLDVLPCDDAILE

SEQ ID NO: 89 - protein, 239 aa, Oryza sativa
MNGCTGGAGGVAAGRLPAVSLQQAQWKLVDERCELREEEMEYVRRFHRHEIGSNQCNSFIAKHVRAPLQNVWSLVRRFDQPQIYKPFVRKCVMRGNVETGSVREIIVQSGLPATRSIERLEFLDDNEYILRVKFIGGDHMLKKRIPKKTYAISSRTCSDSAIIAVGQSNCAPEITAMNGGVSIQPWLILLAFFSSPSNQTNPDSLRDMHPGSWFQILLVLAMFTCSKGSVLPPSEKVNV

SEQ ID NO: 90 - protein, 188 aa, Zea mays
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLESYVVDVPDGNTEEDTRMFTDTVVKLNLQKLAAIATSSSAN

SEQ ID NO: 91 - protein, 205 aa, Zea mays
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLESYAVDVPDGNTEDDTRLFADTVIRLNLQKLKSVAEASTSSSAPPPPSE

SEQ ID NO: 92 - protein, 220 aa, Zea mays
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVESYVVDVPPGNTPEDTRVFVDTIVKCNLQSLATTAEKLAAV

SEQ ID NO: 93 - protein, 221 aa, Glycine max
MEKAESSASTSEPDSDENHHRHPTNHHINPPSGLTPLEFASLIPSVAEHHSYLVGSGQCSSLLAQRVQAPPDAVWSVVRRFDKPQTYKHFIKSCAVKEPFHMAVGVTRDVNVISGLPAATSTERLDLLDDIRCVTGFSIIGGEHRLRNYRSVTTVHSFEDDADDGKIYTVVLESYVVDVPDGNTEEDTRLFADTVVKLNLQKLASVTEGTNRDGDGKSHSR

SEQ ID NO: 94 - protein, 214 aa, Glycine max
MEKTHSSSAEEQDPTRRHLDPPPGLTAEEFEDLKPSVLEHHTYSVTPTRQSSSLLAQRIHAPPHAVWSVVRCFDNPQAYKHFIKSCHVKEGFQLAVGSTRDVHVISGLPAATSTERLDLLDDDRHVIGFTIVGGDHRLRNYRSVTSVHGFECDGKIWTVVLESYVVDVPEGNTEEDTRLFADTVVKLNLQKLASVSEGMCGDGDGDGDGKGNKS

SEQ ID NO: 95 - protein, 216 aa, Glycine max
MLQNSSMSSLLLHRINGGGGATTATNCHDTVFMTVPDGVARYHTHAVAPNQCCSSVAQEIGASVATVWSVLRRFDNPQAYKHFVKSCHVIGGDGDVGTLREVHVISGLPAARSTERLEILDDERHVISFSVVGGDHRLANYRSVTTLHPTASSASGGCSGTVVVESYVVDVPPGNTREDTRVFVDTIVKCNLQSLAQTAENLTLRKNNNNDYKCCS

SEQ ID NO: 96 - protein, 208 aa, Glycine max
MTSLQFHRFNPATDTSTAIANGVNCPKPPSTLRLLAKVSLSVPETVARHHAHPVGPNQCCSVVIQAIDAPVSAVWPVVRRFDNPQAYKHFVKSCHVVAAAGGGEDGIRVGALREVRVVSGLPAVSSTERLEILDDERHVMSFSVVGGDHRLRNYRSVTTLHGDGNGGTVVIESYVVDVPPGNTKEETCVFVDTIVRCNLQSLAQIAET

SEQ ID NO: 97 - protein, 176 aa, Glycine max
AYPVLGLTPEEFSELESIINTHHKFEPSPEICSSIIAQRIDAPAHTVWPLVRSFENPQKYKHFVKSCNMRSGDGGVGSIREVTVVSGLPASTSTERLEILDDDKHLLSFRVVGGEHRLHNYRSVTSVNEFKNPDNGKVYTIVLESYVVDIPEGNTGVDTKMFVDTVVKLNLQKLGE

SEQ ID NO: 98 - protein, 172 aa, Glycine max
EFTELESTINTHHKFEASPEICSSIIAQRIDAPAHTVWPLVRSFENPQKYKHFVKSCNMRSGDGGVGSIREVTVVSGLPASTSTERLEILDDDNHLLSFRVVGGEHRLHNYRSVTSVNEFKRPDNGKVYTIVLESYVVDIPEGNTGVDTKMFVDTVVKLNLQKLGEVAMATN

SEQ ID NO: 99 - protein, 191 aa, Glycine max
MTELSSREVEYIRRHHSKAAEDNQCASALVKHIRAPLPLVWSLVRRFDEPQKYKPFVSRCVVRGNLEIGSLREVDVKSGLPATTSTERLEILDDNHHILSVRIIGGDHRLRNYSSIMSLHPEIVDGRPGTLVIESFVVDIPEGNTKDETCYFVEALIKCNLKSLADVSEGLTLQDHTEPIDRKYELLITRG

SEQ ID NO: 100 - protein, 185 aa, Glycine max
MNGGESYGAIETQYIRRHHKHEPRENQCTSALVKHIRAPVHLVWSLVRRFDQPQKYKPFVSRCIMQGDLGIGSVREVNVKSGLPATTSTERLEQLDDEEHILGIRIVGGDHRLRNYSSIITVHPEVIDGRPGTMVIESFVVDVPDGNTRDETCYFVEALIRCNLSSLADVSERMAVQGRTNPINH

SEQ ID NO: 101 - protein, 178 aa, Glycine max
MSPNNPSTIVSDAVARHHTHVVSPHQCCSAVVQEIAAPVSTVWSVVRRFDNPQAYKHFVKSCHVILGDGDVGTLREVRVISGLPAAVSTERLDVLDDERHVIGFSMVGGDHRLSNYRSVTILHPRSATDTVVVESYVVDVPAGNTTEDTRVFVDTILRCNLQSLAKFAENLTNKLHQR

SEQ ID NO: 102 - protein, 246 aa, Glycine max
MSRSHNKRKPFSFIFKITLLELLSSLLSSSLRFAMDKTHSGEEQDPNPTHPTRNHLDPPPGLTPEEFEDLKPSVLEHHTYSVTPTRQCSSLLAQRIHAPPHTVWTVVRCFDNPQAYKHFIKSCHVKEGFQLAVGSTRDVHVISGLPAATSTERLDLLDDDRHVIGFTIVGGDHRLRNYRSVTSVHGFERDGKIWTVVLESYVVDVPEGNTEEDTRLFADTVVKLNLQKLASVTEGMCGDSDGKGNN

SEQ ID NO: 103 - protein, 223 aa, Glycine max
MEKAESSASTSEPDSDDNHHRHPTNHHLNPPSGLTPLEFASLVPSVAEHHSYLVGPGQCSSLLAQRVHAPPDAVWSFVRRFDKPQTYKHFIKSCAVKEPFHMAVGVTRDVNVISGLPAATSTERLDFLDDVRRVTGFSIIGGEHRLRNYRSVTTVHSFDDDNASADGKIYTVVLESYVVDVPDGNTEEDTRLFADTVVKLNLQKLASVTEGTNGDGDGKPHSR

SEQ ID NO: 104 - protein, 229 aa, Glycine max
MPSSLHFDRFNPITHAATTVAIANGVNCPKQPQAPPSSTAARRLVVPSLSSGRGIAAPDTVALHHAHVVDPNQCCSIVTQHINAPVSAVWAVVRRFDNPQGYKNFVRSCHVITGDGIRVGAVREVRVVSGLPAETSTERLEILDDERHVISFSMVGGDHRLRNYQSVTTLHANGNGTLVIESYVVDVPQGNTKEETCVFVDTIVRCNLQSLAQIAENRTNNCEHTAQHC

SEQ ID NO: 105 - protein, 191 aa, Glycine max
MNGIGNDGGGGLSNVEMEYIRRHHRHEPGENQCGSALVKHIRAPVPQVWSLVRRFDQPQKYKPFVSRCVVRGNLEIGSLREVDVKSGLPATTSTERLELLDDNEHLLSIRIIGGDHRLRNYSSIMSLHPEIIDGRPGTLVIESFVVDVPEGNTKDETCYFVEALIKCNLKSLADVSEGIAVQDRTEPIDRI

SEQ ID NO: 106 - protein, 169 aa, Glycine max
MVARHHAHAVGPNQCCSFVIQAIDAPVSAVWPVVRRFDNPQAYKHFVKSCHVVAAGGAGGDGGIHVGALREVRVVSGLPAVSSTERLEILDDERHVMSFSVVGGDHRLRNYRSVTTLHGDGSNGGTVVIESYVVDIPAGNTKEETCVFVDTIVRCNLQSLAQMAENMGS

SEQ ID NO: 107 - protein, 210 aa, Glycine max
MTILPHSNNKSSNHKFIAHQNYMASETHHHVQGLTPEELTKLEPIIKKYHLFEQSPNTCFSIITYRIEAPAKAVWPFVRSFDNPQKYKHFIKGCNMRGDGGVGSIREVTVVSGLPASTSTERLEILDDDKHVLSFRVVGGEHRLKNYRSVTSVNEFNKEGKVYTIVLESYIVDIPEGNTEEDTKMFVDTVVKLNLQKLGVVAMASSMHGQ

SEQ ID NO: 108 - protein, 193 aa, Glycine max
MNRIGNGGGGGGGLSNVEMEYIRRHHRHEPGENQCGSALVKHIRAPVPQVWSLVRRFDQPQKYKPFISRCVVRGNLEIGSLREVDVKSGLPATTSTERLELLDDNEHILSIRIIGGDHRLRNYSSIMSLHPEIIDGRPGTLVIESFVVDVPEGNTKDETCYFVEALIKCNLKSLADVSEGLAVQDCTEPIDRI

SEQ ID NO: 109 - protein, 188 aa, Glycine max
MASETHHHVQGLTPEELTQLEPIIKKYHLFEASSNKCFSIITHRIEAPASSVWPLVRNFDNPQKYKHFIKGCNMKGDGSVGSIREVTVVSGLPASTSTERLEILDDDKHVLSFRVVGGEHRLQNYRSVTSVNEFHKEGKVYTIVLESYIVDIPEGNTEEDTKMFVDTVVKLNLQKLGVVAMASSMNGR

SEQ ID NO: 110 - protein, 177 aa, Glycine max
MLPNNPSTIVPDAVARHHTHVVSPQQCCSAVVQEIAAPVSTVWSVVRRFDNPQAYKHFVKSCHVILGDGDVGTLREVHVISGLPAAVSTERLDVLDDERHVIGFSMVGGDHRLFNYRSVTTLHPRSAAGTVVVESYVVDVPPGNTTEDTRVFVDTILRCNLQSLAKFAENLTKLHQR

SEQ ID NO: 111 - protein, 185 aa, Glycine max; identical to SEQ ID NO: 100

SEQ ID NO: 112 - protein, 191 aa, Glycine max
MGITIGIQCLEIEEISICDGMFCYLVDFVDVKEKMNYCLMWFGYFPSQVWSLVRRFDQPQKYKPFVSRCIMQGDLGIGSVREVNVKSGLPATTSTERLEQLDDEEHILGIRIVGGDHRLRNYSSIITVHPEVIDGRPSTMVIESFVVDVPDGNTRDETCYFVEALIRCNLSSLADVSERMAVQGRTDPINH

SEQ ID NO: 113 - protein, 185 aa, Artificial Sequence
  synthetic PYR/PYL receptor protein
MNGGESYGAIETQYIRRHHKHEPRENQCTSALVKHIRAPVHLVWSLVRRFDQPQKYKPFVSRCIMQGDLGIGSVREVNVKSGLPATTSTERLEQLDDEEHILGIRIVGGDHRLRNYSSIITVHPEVIDGRPSTMVIESFVVDVPDGNTRDETCYFVEALIRCNLSSLADVSERMAVQGRTDPINH

SEQ ID NO: 114 - protein, 204 aa, Sorghum bicolor
METHVERALRATLTEAEVRALEPAVREHHTFPAGRVAAGTTTPTPTTCTSLVAQRVSAPVRAVWPIVRSFGNPQRYKHFVRTCALAAGDGASVGSVREVTVVSGLPASSSTERLEVLDDDRHILSFRVVGGDHRLRNYRSVTSVTEFQPGPYCVVVESYAVDVPEGNTAEDTRMFTDTVVRLNLQKLAAVAEESAAAAAAGNRR

SEQ ID NO: 115 - protein, 204 aa, Sorghum bicolor
MEPHMETALRQGGLSELEQRELEPVVRAHHTFPGRSPGTTCTSLVTQRVDAPLSAVWPIVRGFAAPQRYKHFIKSCDLRSGDGATVGSVREVTVVSGLPASTSTERLEILDDDRHILSFRVVGGDHRLRNYRSVTSVTEFHHHHQAAAGRPYCVVVESYVVDVPEGNTEEDTRMFTDTVVKLNLQKLAAIATSSAAAAASNSST

SEQ ID NO: 116 - protein, 258 aa, Sorghum bicolor
MVESPNPNSPSRPLCIKYTRAPARHFSPPLPFSSLIISANPIEPKAMDKQGAGGDVEVPAGLGLTAAEYEQLRSTVDAHHRYAVGEGQCSSLLAQRIQAPPAAVWAIVRRFDCPQVYKHFIRSCALRPDPEAGDALRPGRLREVSVISGLPASTSTERLDLLDDAARVFGFSITGGEHRLRNYRSVTTVSELADPGICTVVLESYVVDVPDGNTEDDTRLFADTVIRLNLQKLKSVAEANAAAAASFVSVVPPPEPEE

SEQ ID NO: 117 - protein, 222 aa, Sorghum bicolor
MPCLQASSSPGSMPHQHHGRVLAGVGCAAEVAAAAVAATSPAAGMRCGAHDGEVPAEAARHHEHAAPGPGRCCSAVVQHVAAPASAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVESYVVDVPPGNTPEDTRVFVDTIVKCNLQSLATTAEKLAAV

SEQ ID NO: 118 - protein, 211 aa, Sorghum bicolor
MVEMDGGVGVVGGGQQTPAPRRWRLADELRCDLRAMETDYVRRFHRHEPRDHQCSSAVAKHIKAPVHLVWSLVRRFDQPQLFKPFVSRCEMKGNIEIGSVREVNVKSGLPATRSTERLELLDDNEHILSVKFVGGDHRLQNYSSILTVHPEVIDGRPGTLVIESFVVDVPDGNTKDETCYFVEALLKCNLKSLAEVSERQVIKDQTEPLDR

SEQ ID NO: 119 - protein, 216 aa, Sorghum bicolor
MPYTAPRPSPQQHSRVTGGGAKAAIVAASHGASCAAVPAEVARHHEHAARAGQCCSAVVQAIAAPVGAVWSVVRRFDRPQAYKHFIRSCRLVDDGGGGAGAGAGATVAVGSVREVRVVSGLPATSSRERLEILDDERRVLSFRVVGGEHRLANYRSVTTVHEAEAGAGGTVVVESYVVDVPPGNTADETRVFVDTIVRCNLQSLARTAERLALALA

SEQ ID NO: 120 - protein, 36 aa, Artificial Sequence
  synthetic hypersensitive PYR/PYL receptor consensus sequence
  VARIANT (1)..(36): Xaa = any amino acid
CXSXXXXXXXAPXXXXWXXXXXFXXPXXXXXFXXXC

SEQ ID NO: 121 - protein, 25 aa, Artificial Sequence
  synthetic hypersensitive PYR/PYL receptor consensus sequence
  VARIANT (1)..(25): Xaa = any amino acid
GXXRXVXXXSXXPAXXSXEXLXXXD

SEQ ID NO: 122 - protein, 11 aa, Artificial Sequence
  synthetic hypersensitive PYR/PYL receptor consensus sequence
  VARIANT (1)..(11): Xaa = any amino acid
GGXHRLXNYXS

SEQ ID NO: 123 - protein, 31 aa, Artificial Sequence
  synthetic hypersensitive PYR/PYL receptor consensus sequence
  VARIANT (1)..(31): Xaa = any amino acid
ESXXVDXPXGXXXXXTXXFXXXXXXXNLXXL

SEQ ID NO: 124 - protein, 191 aa, Artificial Sequence
  synthetic Arabidopsis PYR1 mutant F61L
MPSELTPEERSELKNSIAEFHTYQLDPGSCSSLHAQRIHAPPELVWSIVRRFDKPQTYKHLIKSCSVEQNFEMRVGCTRDVIVISGLPANTSTERLDILDDERRVTGFSIIGGEHRLTNYKSVTTVHRFEKENRIWTVVLESYVVDMPEGNSEDDTRMFADTVVKLNLQKLATVAEAMARNSGDGSGSQVT

SEQ ID NO: 125 - protein, 191 aa, Artificial Sequence
  synthetic Arabidopsis PYR1 mutant F61M
MPSELTPEERSELKNSIAEFHTYQLDPGSCSSLHAQRIHAPPELVWSIVRRFDKPQTYKHMIKSCSVEQNFEMRVGCTRDVIVISGLPANTSTERLDILDDERRVTGFSIIGGEHRLTNYKSVTTVHRFEKENRIWTVVLESYVVDMPEGNSEDDTRMFADTVVKLNLQKLATVAEAMARNSGDGSGSQVT

SEQ ID NO: 126 - protein, 191 aa, Artificial Sequence
  synthetic Arabidopsis PYR1 mutant V81I
MPSELTPEERSELKNSIAEFHTYQLDPGSCSSLHAQRIHAPPELVWSIVRRFDKPQTYKHFIKSCSVEQNFEMRVGCTRDIIVISGLPANTSTERLDILDDERRVTGFSIIGGEHRLTNYKSVTTVHRFEKENRIWTVVLESYVVDMPEGNSEDDTRMFADTVVKLNLQKLATVAEAMARNSGDGSGSQVT

SEQ ID NO: 127 - protein, 191 aa, Artificial Sequence
  synthetic Arabidopsis PYR1 mutant V81Y
MPSELTPEERSELKNSIAEFHTYQLDPGSCSSLHAQRIHAPPELVWSIVRRFDKPQTYKHFIKSCSVEQNFEMRVGCTRDYIVISGLPANTSTERLDILDDERRVTGFSIIGGEHRLTNYKSVTTVHRFEKENRIWTVVLESYVVDMPEGNSEDDTRMFADTVVKLNLQKLATVAEAMARNSGDGSGSQVT

SEQ ID NO: 128 - protein, 191 aa, Artificial Sequence
  synthetic Arabidopsis PYR1 mutant I110C
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSCIGGEHRLTNYKSVTTVHRFEKENRIWTVVLESYVVDMPEGNSEDDTRMFADTVVKLNLQKLATVAEAMARNSGDGSGSQVT

SEQ ID NO: 129 - protein, 191 aa, Artificial Sequence
  synthetic Arabidopsis PYR1 mutant I110S
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSSIGGEHRLTNYKSVTTVHRFEKENRIWTVVLESYVVDMPEGNSEDDTRMFADTVVKLNLQKLATVAEAMARNSGDGSGSQVT

SEQ ID NO: 130 - protein, 191 aa, Artificial Sequence
  synthetic Arabidopsis PYR1 mutant E141C
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLCSYVVDMPEGNSEDDTRMFADTVVKLNLQKLATVAEAMARNSGDGSGSQVT

SEQ ID NO: 131 - protein, 191 aa, Artificial Sequence
  synthetic Arabidopsis PYR1 mutant E141I
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLISYVVDMPEGNSEDDTRMFADTVVKLNLQKLATVAEAMARNSGDGSGSQVT

SEQ ID NO: 132 - protein, 191 aa, Artificial Sequence
  synthetic Arabidopsis PYR1 mutant E141L
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLLSYVVDMPEGNSEDDTRMFADTVVKLNLQKLATVAEAMARNSGDGSGSQVT

SEQ ID NO: 133 - protein, 191 aa, Artificial Sequence
  synthetic Arabidopsis PYR1 mutant E141M
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLMSYVVDMPEGNSEDDTRMFADTVVKLNLQKLATVAEAMARNSGDGSGSQVT

SEQ ID NO: 134 - protein, 191 aa, Artificial Sequence
  synthetic Arabidopsis PYR1 mutant E141N
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLNSYVVDMPEGNSEDDTRMFADTVVKLNLQKLATVAEAMARNSGDGSGSQVT

SEQ ID NO: 135 - protein, 191 aa, Artificial Sequence
  synthetic Arabidopsis PYR1 mutant E141T
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLTSYVVDMPEGNSEDDTRMFADTVVKLNLQKLATVAEAMARNSGDGSGSQVT

SEQ ID NO: 136 - protein, 191 aa, Artificial Sequence
  synthetic Arabidopsis PYR1 mutant E141V
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLVSYVVDMPEGNSEDDTRMFADTVVKLNLQKLATVAEAMARNSGDGSGSQVT

SEQ ID NO: 137 - protein, 191 aa, Artificial Sequence
  synthetic Arabidopsis PYR1 mutant E141W
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLWSYVVDMPEGNSEDDTRMFADTVVKLNLQKLATVAEAMARNSGDGSGSQVT

SEQ ID NO: 138 - protein, 191 aa, Artificial Sequence
  synthetic Arabidopsis PYR1 mutant E141Y
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLYSYVVDMPEGNSEDDTRMFADTVVKLNLQKLATVAEAMARNSGDGSGSQVT

SEQ ID NO: 139 - protein, 191 aa, Artificial Sequence
  synthetic Arabidopsis PYR1 mutant A160C
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLESYVVDMPEGNSEDDTRMFCDTVVKLNLQKLATVAEAMARNSGDGSGSQVT

SEQ ID NO: 140 - protein, 191 aa, Artificial Sequence
  synthetic Arabidopsis PYR1 mutant A160I
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLESYVVDMPEGNSEDDTRMFIDTVVKLNLQKLATVAEAMARNSGDGSGSQVT

SEQ ID NO: 141 - protein, 191 aa, Artificial Sequence
  synthetic Arabidopsis PYR1 mutant A160V
MPSELTPEERSELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLESYVVDMPEGNSEDDTRMFVDTVVKLNLQKLATVAEAMARNSGDGSGSQVT

SEQ ID NO: 142 - protein, 174 aa, Artificial Sequence
  synthetic middle portion of Zea mays PYR/PYL (ZmPYLc)
AGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVESYVVDVPPGNTVEETRIFVDTIVRCNLQSLEGTVIRQLEIA

SEQ ID NO: 143 - protein, 172 aa, Artificial Sequence
  synthetic middle portion of Zea mays PYR/PYL (ZmPYLl)
AGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVESYVVDVPPGNTVEETRIFVDTIVRCNLQSLEDTVIRQQAMA

SEQ ID NO: 144 - protein, 170 aa, Artificial Sequence
  synthetic middle portion of Zea mays PYR/PYL (ZmPYLa)
CAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVESYVVDVPHGNTADETRVFVDTIVRCNLQSLARTAERLA

SEQ ID NO: 145 - protein, 171 aa, Artificial Sequence
  synthetic middle portion of Zea mays PYR/PYL (ZmPYLb)
GEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVESYVVDVPPGNTPEDTRVFVDTIVKCNLQSLATTAEKLAAV

SEQ ID NO: 146 - protein, 172 aa, Artificial Sequence
  synthetic middle portion of Zea mays PYR/PYL (ZmPYLo)
GEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVESYVVDVPPGNTPEDTRVFVDTIVKCNLQSLATTAEKLALAA

SEQ ID NO: 147 - protein, 174 aa, Artificial Sequence
  synthetic middle portion of Zea mays PYR/PYL (ZmPYLi)
QLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLESYVVDVPDGNTEDDTRLFADTVIRLNLQKLKSVAEANAAEA

SEQ ID NO: 148 - protein, 174 aa, Artificial Sequence
  synthetic middle portion of Zea mays PYR/PYL (ZmPYLk)
QLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLESYAVDVPDGNTEDDTRLFADTVIRLNLQKLKSVAEASTSSS

SEQ ID NO: 149 - protein, 171 aa, Artificial Sequence
  synthetic middle portion of Arabidopsis thaliana PYR/PYL (AtPyrl)
ELKNSIAEFHTYQLDPGSCSSLHAQRIHAPPELVWSIVRRFDKPQTYKHFIKSCSVEQNFEMRVGCTRDVIVISGLPANTSTERLDILDDERRVTGFSIIGGEHRLTNYKSVTTVHRFEKENRIWTVVLESYVVDMPEGNSEDDTRMFADTVVKLNLQKLATVAEAMARNS

SEQ ID NO: 150 - protein, 169 aa, Artificial Sequence
  synthetic middle portion of Zea mays PYR/PYL (ZmPYLj)
ELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLESYVVDVPDGNTEEDTRMFTDTVVKLNLQKLAAIATSSSAN

SEQ ID NO: 151 - protein, 171 aa, Artificial Sequence
  synthetic middle portion of Zea mays PYR/PYL (ZmPYLd)
RAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILTVHPEVIDGRPGTLVIESFVVDVPDGNTKDETCYFVEALLKCNLRSLAEVSEGQVIMD

SEQ ID NO: 152 - protein, 171 aa, Artificial Sequence
  synthetic middle portion of Zea mays PYR/PYL (ZmPYLf)
RAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILTVHPEVIDGRPGTLVIESFVVDVPDGNTKDETCYFVEALLKCNLKSLAEVSERQVVKD

SEQ ID NO: 153 - protein, 172 aa, Artificial Sequence
  synthetic middle portion of Zea mays PYR/PYL (ZmPYLe)
AGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFVEAVIKCNLNSLAEVSEQLAVES

SEQ ID NO: 154 - protein, 172 aa, Artificial Sequence
  synthetic middle portion of Zea mays PYR/PYL (ZmPYLg)
AGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFVEAVIKCNLKSLAEVSEQLAVES

SEQ ID NO: 155 - protein, 233 aa, Artificial Sequence
  synthetic ZmPYLc homologous to AtPYR1 A160C
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVESYVVDVPPGNTVEETRIFCDTIVRCNLQSLEGTVIRQLEIAAMPHDDNQN

SEQ ID NO: 156 - protein, 213 aa, Artificial Sequence
  synthetic ZmPYLl homologous to AtPYR1 A160C
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVESYVVDVPPGNTVEETRIFCDTIVRCNLQSLEDTVIRQQAMAAPAAPHNDHNHS

SEQ ID NO: 157 - protein, 200 aa, Artificial Sequence
  synthetic ZmPYLa homologous to AtPYR1 A160C
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVESYVVDVPHGNTADETRVFCDTIVRCNLQSLARTAERLA

SEQ ID NO: 158 - protein, 220 aa, Artificial Sequence
  synthetic ZmPYLb homologous to AtPYR1 A160C
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVESYVVDVPPGNTPEDTRVFCDTIVKCNLQSLATTAEKLAAV

SEQ ID NO: 159 - protein, 218 aa, Artificial Sequence
  synthetic ZmPYLo homologous to AtPYR1 A160C
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVESYVVDVPPGNTPEDTRVFCDTIVKCNLQSLATTAEKLALAAV

SEQ ID NO: 160 - protein, 212 aa, Artificial Sequence
  synthetic ZmPYLi homologous to AtPYR1 A160C
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLESYVVDVPDGNTEDDTRLFCDTVIRLNLQKLKSVAEANAAEAAATTNSVLLPRPAE

SEQ ID NO: 161 - protein, 205 aa, Artificial Sequence
  synthetic ZmPYLk homologous to AtPYR1 A160C
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLESYAVDVPDGNTEDDTRLFCDTVIRLNLQKLKSVAEASTSSSAPPPPSE

SEQ ID NO: 162 - protein, 188 aa, Artificial Sequence
  synthetic ZmPYLj homologous to AtPYR1 A160C
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLESYVVDVPDGNTEEDTRMFCDTVVKLNLQKLAAIATSSSAN

SEQ ID NO: 163 - protein, 214 aa, Artificial Sequence
  synthetic ZmPYLd homologous to AtPYR1 A160C
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLESYVVDVPDGNTEEDTRMFCDTVVKLNLQKLAAIATSSSANQTEPLDR

SEQ ID NO: 164 - protein, 209 aa, Artificial Sequence
  synthetic ZmPYLf homologous to AtPYR1 A160C
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLESYVVDVPDGNTEEDTRMFCDTVVKLNLQKLAAIATSSSANQTEPLDR

SEQ ID NO: 165 - protein, 197 aa, Artificial Sequence
  synthetic ZmPYLe homologous to AtPYR1 A160C
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFCEAVIKCNLNSLAEVSEQLAVESPTSLIDQ

SEQ ID NO: 166 - protein, 197 aa, Artificial Sequence
  synthetic ZmPYLg homologous to AtPYR1 A160C
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFCEAVIKCNLKSLAEVSEQLAVESPTSPIDQ

SEQ ID NO: 167 - protein, 233 aa, Artificial Sequence
  synthetic ZmPYLc homologous to AtPYR1 A160I
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVESYVVDVPPGNTVEETRIFIDTIVRCNLQSLEGTVIRQLEIAAMPHDDNQN

SEQ ID NO: 168 - protein, 213 aa, Artificial Sequence
  synthetic ZmPYLl homologous to AtPYR1 A160I
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVESYVVDVPPGNTVEETRIFIDTIVRCNLQSLEDTVIRQQAMAAPAAPHNDHNHS

SEQ ID NO: 169 - protein, 200 aa, Artificial Sequence
  synthetic ZmPYLa homologous to AtPYR1 A160I
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVESYVVDVPHGNTADETRVFIDTIVRCNLQSLARTAERLA

SEQ ID NO: 170 - protein, 220 aa, Artificial Sequence
  synthetic ZmPYLb homologous to AtPYR1 A160I
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVESYVVDVPPGNTPEDTRVFIDTIVKCNLQSLATTAEKLAAV

SEQ ID NO: 171 - protein, 218 aa, Artificial Sequence
  synthetic ZmPYLo homologous to AtPYR1 A160I
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVESYVVDVPPGNTPEDTRVFIDTIVKCNLQSLATTAEKLALAAV

SEQ ID NO: 172 - protein, 212 aa, Artificial Sequence
  synthetic ZmPYLi homologous to AtPYR1 A160I
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLESYVVDVPDGNTEDDTRLFIDTVIRLNLQKLKSVAEANAAEAAATTNSVLLPRPAE

SEQ ID NO: 173 - protein, 205 aa, Artificial Sequence
  synthetic ZmPYLk homologous to AtPYR1 A160I
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLESYAVDVPDGNTEDDTRLFIDTVIRLNLQKLKSVAEASTSSSAPPPPSE

SEQ ID NO: 174 - protein, 188 aa, Artificial Sequence
  synthetic ZmPYLj homologous to AtPYR1 A160I
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLESYVVDVPDGNTEEDTRMFIDTVVKLNLQKLAAIATSSSAN

SEQ ID NO: 175 - protein, 214 aa, Artificial Sequence
  synthetic ZmPYLd homologous to AtPYR1 A160I
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLESYVVDVPDGNTEEDTRMFIDTVVKLNLQKLAAIATSSSANQTEPLDR

SEQ ID NO: 176 - protein, 209 aa, Artificial Sequence
  synthetic ZmPYLf homologous to AtPYR1 A160I
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLESYVVDVPDGNTEEDTRMFIDTVVKLNLQKLAAIATSSSANQTEPLDR

SEQ ID NO: 177 - protein, 197 aa, Artificial Sequence
  synthetic ZmPYLe homologous to AtPYR1 A160I
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFIEAVIKCNLNSLAEVSEQLAVESPTSLIDQ

SEQ ID NO: 178 - protein, 197 aa, Artificial Sequence
  synthetic ZmPYLg homologous to AtPYR1 A160I
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFIEAVIKCNLKSLAEVSEQLAVESPTSPIDQ

SEQ ID NO: 179 - protein, 212 aa, Artificial Sequence
  synthetic ZmPYLi homologous to AtPYR1 A160V
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLESYVVDVPDGNTEDDTRLFADTVIRLNLQKLKSVAEANAAEAAATTNSVLLPRPAE

SEQ ID NO: 180 - protein, 205 aa, Artificial Sequence; identical to SEQ ID NO: 91
  synthetic ZmPYLk homologous to AtPYR1 A160V

SEQ ID NO: 181 - protein, 188 aa, Artificial Sequence; identical to SEQ ID NO: 90
  synthetic ZmPYLj homologous to AtPYR1 A160V

SEQ ID NO: 182 - protein, 233 aa, Artificial Sequence
  synthetic ZmPYLc homologous to AtPYR1 E141C
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVCSYVVDVPPGNTVEETRIFVDTIVRCNLQSLEGTVIRQLEIAAMPHDDNQN

SEQ ID NO: 183 - protein, 213 aa, Artificial Sequence
  synthetic ZmPYLl homologous to AtPYR1 E141C
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVCSYVVDVPPGNTVEETRIFVDTIVRCNLQSLEDTVIRQQAMAAPAAPHNDHNHS

SEQ ID NO: 184 - protein, 200 aa, Artificial Sequence
  synthetic ZmPYLa homologous to AtPYR1 E141C
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVCSYVVDVPHGNTADETRVFVDTIVRCNLQSLARTAERLA

SEQ ID NO: 185 - protein, 220 aa, Artificial Sequence
  synthetic ZmPYLb homologous to AtPYR1 E141C
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVCSYVVDVPPGNTPEDTRVFVDTIVKCNLQSLATTAEKLAAV

SEQ ID NO: 186 - protein, 218 aa, Artificial Sequence
  synthetic ZmPYLo homologous to AtPYR1 E141C
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVCSYVVDVPPGNTPEDTRVFVDTIVKCNLQSLATTAEKLALAAV

SEQ ID NO: 187 - protein, 212 aa, Artificial Sequence
  synthetic ZmPYLi homologous to AtPYR1 E141C
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLCSYVVDVPDGNTEDDTRLFADTVIRLNLQKLKSVAEANAAEAAATTNSVLLPRPAE

SEQ ID NO: 188 - protein, 205 aa, Artificial Sequence
  synthetic ZmPYLk homologous to AtPYR1 E141C
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLCSYAVDVPDGNTEDDTRLFADTVIRLNLQKLKSVAEASTSSSAPPPPSE

SEQ ID NO: 189 - protein, 188 aa, Artificial Sequence
  synthetic ZmPYLj homologous to AtPYR1 E141C
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLCSYVVDVPDGNTEEDTRMFTDTVVKLNLQKLAAIATSSSAN

SEQ ID NO: 190 - protein, 214 aa, Artificial Sequence
  synthetic ZmPYLd homologous to AtPYR1 E141C
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLCSYVVDVPDGNTEEDTRMFTDTVVKLNLQKLAAIATSSSANQTEPLDR

SEQ ID NO: 191 - protein, 209 aa, Artificial Sequence
  synthetic ZmPYLf homologous to AtPYR1 E141C
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLCSYVVDVPDGNTEEDTRMFTDTVVKLNLQKLAAIATSSSANQTEPLDR

SEQ ID NO: 192 - protein, 197 aa, Artificial Sequence
  synthetic ZmPYLe homologous to AtPYR1 E141C
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVICSFVVDVPDGNTKDETCYFVEAVIKCNLNSLAEVSEQLAVESPTSLIDQ

SEQ ID NO: 193 - protein, 197 aa, Artificial Sequence
  synthetic ZmPYLg homologous to AtPYR1 E141C
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVICSFVVDVPDGNTKDETCYFVEAVIKCNLKSLAEVSEQLAVESPTSPIDQ

SEQ ID NO: 194 - protein, 233 aa, Artificial Sequence
  synthetic ZmPYLc homologous to AtPYR1 E141I
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVISYVVDVPPGNTVEETRIFVDTIVRCNLQSLEGTVIRQLEIAAMPHDDNQN

SEQ ID NO: 195 - protein, 213 aa, Artificial Sequence
  synthetic ZmPYLl homologous to AtPYR1 E141I
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVISYVVDVPPGNTVEETRIFVDTIVRCNLQSLEDTVIRQQAMAAPAAPHNDHNHS

SEQ ID NO: 196 - protein, 200 aa, Artificial Sequence
  synthetic ZmPYLa homologous to AtPYR1 E141I
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVISYVVDVPHGNTADETRVFVDTIVRCNLQSLARTAERLA

SEQ ID NO: 197 - protein, 220 aa, Artificial Sequence
  synthetic ZmPYLb homologous to AtPYR1 E141I
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVISYVVDVPPGNTPEDTRVFVDTIVKCNLQSLATTAEKLAAV

SEQ ID NO: 198 - protein, 218 aa, Artificial Sequence
  synthetic ZmPYLo homologous to AtPYR1 E141I
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVISYVVDVPPGNTPEDTRVFVDTIVKCNLQSLATTAEKLALAAV

SEQ ID NO: 199 - protein, 212 aa, Artificial Sequence
  synthetic ZmPYLi homologous to AtPYR1 E141I
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLISYVVDVPDGNTEDDTRLFADTVIRLNLQKLKSVAEANAAEAAATTNSVLLPRPAE

SEQ ID NO: 200 - protein, 205 aa, Artificial Sequence
  synthetic ZmPYLk homologous to AtPYR1 E141I
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLISYAVDVPDGNTEDDTRLFADTVIRLNLQKLKSVAEASTSSSAPPPPSE

SEQ ID NO: 201 - protein, 188 aa, Artificial Sequence
  synthetic ZmPYLj homologous to AtPYR1 E141I
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLISYVVDVPDGNTEEDTRMFTDTVVKLNLQKLAAIATSSSAN

SEQ ID NO: 202 - protein, 214 aa, Artificial Sequence
  synthetic ZmPYLd homologous to AtPYR1 E141I
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLISYVVDVPDGNTEEDTRMFTDTVVKLNLQKLAAIATSSSANQTEPLDR

SEQ ID NO: 203 - protein, 209 aa, Artificial Sequence
  synthetic ZmPYLf homologous to AtPYR1 E141I
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLISYVVDVPDGNTEEDTRMFTDTVVKLNLQKLAAIATSSSANQTEPLDR

SEQ ID NO: 204 - protein, 197 aa, Artificial Sequence
  synthetic ZmPYLe homologous to AtPYR1 E141I
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVIISFVVDVPDGNTKDETCYFVEAVIKCNLNSLAEVSEQLAVESPTSLIDQ

SEQ ID NO: 205 - protein, 197 aa, Artificial Sequence
  synthetic ZmPYLg homologous to AtPYR1 E141I
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVIISFVVDVPDGNTKDETCYFVEAVIKCNLKSLAEVSEQLAVESPTSPIDQ

SEQ ID NO: 206 - protein, 233 aa, Artificial Sequence
  synthetic ZmPYLc homologous to AtPYR1 E141L
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVLSYVVDVPPGNTVEETRIFVDTIVRCNLQSLEGTVIRQLEIAAMPHDDNQN

SEQ ID NO: 207 - protein, 213 aa, Artificial Sequence
  synthetic ZmPYLl homologous to AtPYR1 E141L
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVLSYVVDVPPGNTVEETRIFVDTIVRCNLQSLEDTVIRQQAMAAPAAPHNDHNHS

SEQ ID NO: 208 - protein, 200 aa, Artificial Sequence
  synthetic ZmPYLa homologous to AtPYR1 E141L
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVLSYVVDVPHGNTADETRVFVDTIVRCNLQSLARTAERLA

SEQ ID NO: 209 - protein, 220 aa, Artificial Sequence
  synthetic ZmPYLb homologous to AtPYR1 E141L
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVLSYVVDVPPGNTPEDTRVFVDTIVKCNLQSLATTAEKLAAV

SEQ ID NO: 210 - protein, 218 aa, Artificial Sequence
  synthetic ZmPYLo homologous to AtPYR1 E141L
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVLSYVVDVPPGNTPEDTRVFVDTIVKCNLQSLATTAEKLALAAV

SEQ ID NO: 211 - protein, 212 aa, Artificial Sequence
  synthetic ZmPYLi homologous to AtPYR1 E141L
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLLSYVVDVPDGNTEDDTRLFADTVIRLNLQKLKSVAEANAAEAAATTNSVLLPRPAE

SEQ ID NO: 212 - protein, 205 aa, Artificial Sequence
  synthetic ZmPYLk homologous to AtPYR1 E141L
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLLSYAVDVPDGNTEDDTRLFADTVIRLNLQKLKSVAEASTSSSAPPPPSE

SEQ ID NO: 213 - protein, 188 aa, Artificial Sequence
  synthetic ZmPYLj homologous to AtPYR1 E141L
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLLSYVVDVPDGNTEEDTRMFTDTVVKLNLQKLAAIATSSSAN

SEQ ID NO: 214 - protein, 214 aa, Artificial Sequence
  synthetic ZmPYLd homologous to AtPYR1 E141L
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLLSYVVDVPDGNTEEDTRMFTDTVVKLNLQKLAAIATSSSANQTEPLDR

SEQ ID NO: 215 - protein, 209 aa, Artificial Sequence
  synthetic ZmPYLf homologous to AtPYR1 E141L
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLLSYVVDVPDGNTEEDTRMFTDTVVKLNLQKLAAIATSSSANQTEPLDR

SEQ ID NO: 216 - protein, 197 aa, Artificial Sequence
  synthetic ZmPYLe homologous to AtPYR1 E141L
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVILSFVVDVPDGNTKDETCYFVEAVIKCNLNSLAEVSEQLAVESPTSLIDQ

SEQ ID NO: 217 - protein, 197 aa, Artificial Sequence
  synthetic ZmPYLg homologous to AtPYR1 E141L
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVILSFVVDVPDGNTKDETCYFVEAVIKCNLKSLAEVSEQLAVESPTSPIDQ

SEQ ID NO: 218 - protein, 233 aa, Artificial Sequence
  synthetic ZmPYLc homologous to AtPYR1 E141M
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVMSYVVDVPPGNTVEETRIFVDTIVRCNLQSLEGTVIRQLEIAAMPHDDNQN

SEQ ID NO: 219 - protein, 213 aa, Artificial Sequence
  synthetic ZmPYLl homologous to AtPYR1 E141M
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVMSYVVDVPPGNTVEETRIFVDTIVRCNLQSLEDTVIRQQAMAAPAAPHNDHNHS

SEQ ID NO: 220 - protein, 200 aa, Artificial Sequence
  synthetic ZmPYLa homologous to AtPYR1 E141M
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVMSYVVDVPHGNTADETRVFVDTIVRCNLQSLARTAERLA

SEQ ID NO: 221 - protein, 220 aa, Artificial Sequence
  synthetic ZmPYLb homologous to AtPYR1 E141M
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVMSYVVDVPPGNTPEDTRVFVDTIVKCNLQSLATTAEKLAAV

SEQ ID NO: 222 - protein, 218 aa, Artificial Sequence
  synthetic ZmPYLo homologous to AtPYR1 E141M
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVMSYVVDVPPGNTPEDTRVFVDTIVKCNLQSLATTAEKLALAAV

SEQ ID NO: 223 - protein, 212 aa, Artificial Sequence
  synthetic ZmPYLi homologous to AtPYR1 E141M
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLMSYVVDVPDGNTEDDTRLFADTVIRLNLQKLKSVAEANAAEAAATTNSVLLPRPAE

SEQ ID NO: 224 - protein, 205 aa, Artificial Sequence
  synthetic ZmPYLk homologous to AtPYR1 E141M
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLMSYAVDVPDGNTEDDTRLFADTVIRLNLQKLKSVAEASTSSSAPPPPSE

SEQ ID NO: 225 - protein, 188 aa, Artificial Sequence
  synthetic ZmPYLj homologous to AtPYR1 E141M
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLMSYVVDVPDGNTEEDTRMFTDTVVKLNLQKLAAIATSSSAN

SEQ ID NO: 226 - protein, 214 aa, Artificial Sequence
  synthetic ZmPYLd homologous to AtPYR1 E141M
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLMSYVVDVPDGNTEEDTRMFTDTVVKLNLQKLAAIATSSSANQTEPLDR

SEQ ID NO: 227 - protein, 209 aa, Artificial Sequence
  synthetic ZmPYLf homologous to AtPYR1 E141M
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLMSYVVDVPDGNTEEDTRMFTDTVVKLNLQKLAAIATSSSANQTEPLDR

SEQ ID NO: 228 - protein, 197 aa, Artificial Sequence
  synthetic ZmPYLe homologous to AtPYR1 E141M
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVIMSFVVDVPDGNTKDETCYFVEAVIKCNLNSLAEVSEQLAVESPTSLIDQ

SEQ ID NO: 229 - protein, 197 aa, Artificial Sequence
  synthetic ZmPYLg homologous to AtPYR1 E141M
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVIMSFVVDVPDGNTKDETCYFVEAVIKCNLKSLAEVSEQLAVESPTSPIDQ

SEQ ID NO: 230 - protein, 233 aa, Artificial Sequence
  synthetic ZmPYLc homologous to AtPYR1 E141N
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVNSYVVDVPPGNTVEETRIFVDTIVRCNLQSLEGTVIRQLEIAAMPHDDNQN

SEQ ID NO: 231 - protein, 213 aa, Artificial Sequence
  synthetic ZmPYLl homologous to AtPYR1 E141N
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVNSYVVDVPPGNTVEETRIFVDTIVRCNLQSLEDTVIRQQAMAAPAAPHNDHNHS

SEQ ID NO: 232 - protein, 200 aa, Artificial Sequence
  synthetic ZmPYLa homologous to AtPYR1 E141N
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVNSYVVDVPHGNTADETRVFVDTIVRCNLQSLARTAERLA

SEQ ID NO: 233 - protein, 220 aa, Artificial Sequence
  synthetic ZmPYLb homologous to AtPYR1 E141N
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVNSYVVDVPPGNTPEDTRVFVDTIVKCNLQSLATTAEKLAAV

SEQ ID NO: 234 - protein, 218 aa, Artificial Sequence
  synthetic ZmPYLo homologous to AtPYR1 E141N
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVNSYVVDVPPGNTPEDTRVFVDTIVKCNLQSLATTAEKLALAAV

SEQ ID NO: 235 - protein, 212 aa, Artificial Sequence
  synthetic ZmPYLi homologous to AtPYR1 E141N
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLNSYVVDVPDGNTEDDTRLFADTVIRLNLQKLKSVAEANAAEAAATTNSVLLPRPAE

SEQ ID NO: 236 - protein, 205 aa, Artificial Sequence
  synthetic ZmPYLk homologous to AtPYR1 E141N
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLNSYAVDVPDGNTEDDTRLFADTVIRLNLQKLKSVAEASTSSSAPPPPSE

SEQ ID NO: 237 - protein, 188 aa, Artificial Sequence
  synthetic ZmPYLj homologous to AtPYR1 E141N
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLNSYVVDVPDGNTEEDTRMFTDTVVKLNLQKLAAIATSSSAN

SEQ ID NO: 238 - protein, 214 aa, Artificial Sequence
  synthetic ZmPYLd homologous to AtPYR1 E141N
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLNSYVVDVPDGNTEEDTRMFTDTVVKLNLQKLAAIATSSSANQTEPLDR

SEQ ID NO: 239 - protein, 209 aa, Artificial Sequence
  synthetic ZmPYLf homologous to AtPYR1 E141N
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLNSYVVDVPDGNTEEDTRMFTDTVVKLNLQKLAAIATSSSANQTEPLDR

SEQ ID NO: 240 - protein, 197 aa, Artificial Sequence
  synthetic ZmPYLe homologous to AtPYR1 E141N
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVINSFVVDVPDGNTKDETCYFVEAVIKCNLNSLAEVSEQLAVESPTSLIDQ

SEQ ID NO: 241 - protein, 197 aa, Artificial Sequence
  synthetic ZmPYLg homologous to AtPYR1 E141N
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVINSFVVDVPDGNTKDETCYFVEAVIKCNLKSLAEVSEQLAVESPTSPIDQ

SEQ ID NO: 242 - protein, 233 aa, Artificial Sequence
  synthetic ZmPYLc homologous to AtPYR1 E141T
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVTSYVVDVPPGNTVEETRIFVDTIVRCNLQSLEGTVIRQLEIAAMPHDDNQN

SEQ ID NO: 243 - protein, 213 aa, Artificial Sequence
  synthetic ZmPYLl homologous to AtPYR1 E141T
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVTSYVVDVPPGNTVEETRIFVDTIVRCNLQSLEDTVIRQQAMAAPAAPHNDHNHS

SEQ ID NO: 244 - protein, 200 aa, Artificial Sequence
  synthetic ZmPYLa homologous to AtPYR1 E141T
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVTSYVVDVPHGNTADETRVFVDTIVRCNLQSLARTAERLA

SEQ ID NO: 245 - protein, 220 aa, Artificial Sequence
  synthetic ZmPYLb homologous to AtPYR1 E141T
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVTSYVVDVPPGNTPEDTRVFVDTIVKCNLQSLATTAEKLAAV

SEQ ID NO: 246 - protein, 218 aa, Artificial Sequence
  synthetic ZmPYLo homologous to AtPYR1 E141T
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVTSYVVDVPPGNTPEDTRVFVDTIVKCNLQSLATTAEKLALAAV

SEQ ID NO: 247 - protein, 212 aa, Artificial Sequence
  synthetic ZmPYLi homologous to AtPYR1 E141T
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLTSYVVDVPDGNTEDDTRLFADTVIRLNLQKLKSVAEANAAEAAATTNSVLLPRPAE

SEQ ID NO: 248 - protein, 205 aa, Artificial Sequence
  synthetic ZmPYLk homologous to AtPYR1 E141T
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLTSYAVDVPDGNTEDDTRLFADTVIRLNLQKLKSVAEASTSSSAPPPPSE

SEQ ID NO: 249 - protein, 188 aa, Artificial Sequence
  synthetic ZmPYLj homologous to AtPYR1 E141T
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLTSYVVDVPDGNTEEDTRMFTDTVVKLNLQKLAAIATSSSAN

SEQ ID NO: 250 - protein, 214 aa, Artificial Sequence
  synthetic ZmPYLd homologous to AtPYR1 E141T
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLTSYVVDVPDGNTEEDTRMFTDTVVKLNLQKLAAIATSSSANQTEPLDR

SEQ ID NO: 251 - protein, 209 aa, Artificial Sequence
  synthetic ZmPYLf homologous to AtPYR1 E141T
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLTSYVVDVPDGNTEEDTRMFTDTVVKLNLQKLAAIATSSSANQTEPLDR

SEQ ID NO: 252 - protein, 197 aa, Artificial Sequence
  synthetic ZmPYLe homologous to AtPYR1 E141T
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVITSFVVDVPDGNTKDETCYFVEAVIKCNLNSLAEVSEQLAVESPTSLIDQ

SEQ ID NO: 253 - protein, 197 aa, Artificial Sequence
  synthetic ZmPYLg homologous to AtPYR1 E141T
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVITSFVVDVPDGNTKDETCYFVEAVIKCNLKSLAEVSEQLAVESPTSPIDQ

SEQ ID NO: 254 - protein, 233 aa, Artificial Sequence
  synthetic ZmPYLc homologous to AtPYR1 E141V
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVVSYVVDVPPGNTVEETRIFVDTIVRCNLQSLEGTVIRQLEIAAMPHDDNQN

SEQ ID NO: 255 - protein, 213 aa, Artificial Sequence
  synthetic ZmPYLl homologous to AtPYR1 E141V
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVVSYVVDVPPGNTVEETRIFVDTIVRCNLQSLEDTVIRQQAMAAPAAPHNDHNHS

SEQ ID NO: 256 - protein, 200 aa, Artificial Sequence
  synthetic ZmPYLa homologous to AtPYR1 E141V
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVVSYVVDVPHGNTADETRVFVDTIVRCNLQSLARTAERLA

SEQ ID NO: 257 - protein, 220 aa, Artificial Sequence
  synthetic ZmPYLb homologous to AtPYR1 E141V
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVVSYVVDVPPGNTPEDTRVFVDTIVKCNLQSLATTAEKLAAV

SEQ ID NO: 258 - protein, 218 aa, Artificial Sequence
  synthetic ZmPYLo homologous to AtPYR1 E141V
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVVSYVVDVPPGNTPEDTRVFVDTIVKCNLQSLATTAEKLALAAV

SEQ ID NO: 259 - protein, 212 aa, Artificial Sequence
  synthetic ZmPYLi homologous to AtPYR1 E141V
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLVSYVVDVPDGNTEDDTRLFADTVIRLNLQKLKSVAEANAAEAAATTNSVLLPRPAE

SEQ ID NO: 260 - protein, 205 aa, Artificial Sequence
  synthetic ZmPYLk homologous to AtPYR1 E141V
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLVSYAVDVPDGNTEDDTRLFADTVIRLNLQKLKSVAEASTSSSAPPPPSE

SEQ ID NO: 261 - protein, 188 aa, Artificial Sequence
  synthetic ZmPYLj homologous to AtPYR1 E141V
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLVSYVVDVPDGNTEEDTRMFTDTVVKLNLQKLAAIATSSSAN

SEQ ID NO: 262 - protein, 214 aa, Artificial Sequence
  synthetic ZmPYLd homologous to AtPYR1 E141V
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLVSYVVDVPDGNTEEDTRMFTDTVVKLNLQKLAAIATSSSANQTEPLDR

SEQ ID NO: 263 - protein, 209 aa, Artificial Sequence
  synthetic ZmPYLf homologous to AtPYR1 E141V
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLVSYVVDVPDGNTEEDTRMFTDTVVKLNLQKLAAIATSSSANQTEPLDR

SEQ ID NO: 264 - protein, 197 aa, Artificial Sequence
  synthetic ZmPYLe homologous to AtPYR1 E141V
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVIVSFVVDVPDGNTKDETCYFVEAVIKCNLNSLAEVSEQLAVESPTSLIDQ

SEQ ID NO: 265 - protein, 197 aa, Artificial Sequence
  synthetic ZmPYLg homologous to AtPYR1 E141V
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVIVSFVVDVPDGNTKDETCYFVEAVIKCNLKSLAEVSEQLAVESPTSPIDQ

SEQ ID NO: 266 - protein, 233 aa, Artificial Sequence
  synthetic ZmPYLc homologous to AtPYR1 E141W
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVWSYVVDVPPGNTVEETRIFVDTIVRCNLQSLEGTVIRQLEIAAMPHDDNQN

SEQ ID NO: 267 - protein, 213 aa, Artificial Sequence
  synthetic ZmPYLl homologous to AtPYR1 E141W
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVWSYVVDVPPGNTVEETRIFVDTIVRCNLQSLEDTVIRQQAMAAPAAPHNDHNHS

SEQ ID NO: 268 - protein, 200 aa, Artificial Sequence
  synthetic ZmPYLa homologous to AtPYR1 E141W
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVWSYVVDVPHGNTADETRVFVDTIVRCNLQSLARTAERLA

SEQ ID NO: 269 - protein, 220 aa, Artificial Sequence
  synthetic ZmPYLb homologous to AtPYR1 E141W
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVWSYVVDVPPGNTPEDTRVFVDTIVKCNLQSLATTAEKLAAV

SEQ ID NO: 270 - protein, 218 aa, Artificial Sequence
  synthetic ZmPYLo homologous to AtPYR1 E141W
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVWSYVVDVPPGNTPEDTRVFVDTIVKCNLQSLATTAEKLALAAV

SEQ ID NO: 271 - protein, 212 aa, Artificial Sequence
  synthetic ZmPYLi homologous to AtPYR1 E141W
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLWSYVVDVPDGNTEDDTRLFADTVIRLNLQKLKSVAEANAAEAAATTNSVLLPRPAE

SEQ ID NO: 272 - protein, 205 aa, Artificial Sequence
  synthetic ZmPYLk homologous to AtPYR1 E141W
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLWSYAVDVPDGNTEDDTRLFADTVIRLNLQKLKSVAEASTSSSAPPPPSE

SEQ ID NO: 273 - protein, 188 aa, Artificial Sequence
  synthetic ZmPYLj homologous to AtPYR1 E141W
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLWSYVVDVPDGNTEEDTRMFTDTVVKLNLQKLAAIATSSSAN

SEQ ID NO: 274 - protein, 214 aa, Artificial Sequence
  synthetic ZmPYLd homologous to AtPYR1 E141W
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLWSYVVDVPDGNTEEDTRMFTDTVVKLNLQKLAAIATSSSANQTEPLDR

SEQ ID NO: 275 - protein, 209 aa, Artificial Sequence
  synthetic ZmPYLf homologous to AtPYR1 E141W
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLWSYVVDVPDGNTEEDTRMFTDTVVKLNLQKLAAIATSSSANQTEPLDR

SEQ ID NO: 276 - protein, 197 aa, Artificial Sequence
  synthetic ZmPYLe homologous to AtPYR1 E141W
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVIWSFVVDVPDGNTKDETCYFVEAVIKCNLNSLAEVSEQLAVESPTSLIDQ

SEQ ID NO: 277 - protein, 197 aa, Artificial Sequence
  synthetic ZmPYLg homologous to AtPYR1 E141W
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVIWSFVVDVPDGNTKDETCYFVEAVIKCNLKSLAEVSEQLAVESPTSPIDQ

SEQ ID NO: 278 - protein, 233 aa, Artificial Sequence
  synthetic ZmPYLc homologous to AtPYR1 E141Y
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVYSYVVDVPPGNTVEETRIFVDTIVRCNLQSLEGTVIRQLEIAAMPHDDNQN

SEQ ID NO: 279 - protein, 213 aa, Artificial Sequence
  synthetic ZmPYLl homologous to AtPYR1 E141Y
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVYSYVVDVPPGNTVEETRIFVDTIVRCNLQSLEDTVIRQQAMAAPAAPHNDHNHS

SEQ ID NO: 280 - protein, 200 aa, Artificial Sequence
  synthetic ZmPYLa homologous to AtPYR1 E141Y
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVYSYVVDVPHGNTADETRVFVDTIVRCNLQSLARTAERLA

SEQ ID NO: 281 - protein, 220 aa, Artificial Sequence
  synthetic ZmPYLb homologous to AtPYR1 E141Y
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRVVGGEHRLRNYLSVTTVHPSPAAPDAATVVVYSYVVDVPPGNTPEDTRVFVDTIVKCNLQSLATTAEKLAAV

SEQ ID NO: 282 - protein, 218 aa, Artificial Sequence
  synthetic ZmPYLo homologous to AtPYR1 E141Y
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVYSYVVDVPPGNTPEDTRVFVDTIVKCNLQSLATTAEKLALAAV

SEQ ID NO: 283 - protein, 212 aa, Artificial Sequence
  synthetic ZmPYLi homologous to AtPYR1 E141Y
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLYSYVVDVPDGNTEDDTRLFADTVIRLNLQKLKSVAEANAAEAAATTNSVLLPRPAE

SEQ ID NO: 284 - protein, 205 aa, Artificial Sequence
  synthetic ZmPYLk homologous to AtPYR1 E141Y
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSITGGEHRLRNYRSVTTVSELAGPGICTVVLYSYAVDVPDGNTEDDTRLFADTVIRLNLQKLKSVAEASTSSSAPPPPSE

SEQ ID NO: 285 - protein, 188 aa, Artificial Sequence
  synthetic ZmPYLj homologous to AtPYR1 E141Y
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRVVGGDHRLRNYRSVTSVTEFQPGPYCVVLYSYVVDVPDGNTEEDTRMFTDTVVKLNLQKLAAIATSSSAN

SEQ ID NO: 286 - protein, 214 aa, Artificial Sequence
  synthetic ZmPYLd homologous to AtPYR1 E141Y
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRFVGGDHRLQNYSSILSVTEFQPGPYCVVLYSYVVDVPDGNTEEDTRMFTDTVVKLNLQKLAAIATSSSANQTEPLDR

SEQ ID NO: 287 - protein, 209 aa, Artificial Sequence
  synthetic ZmPYLf homologous to AtPYR1 E141Y
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRFVGGDHRLQNYSSILSVTEFQPGPYCVVLYSYVVDVPDGNTEEDTRMFTDTVVKLNLQKLAAIATSSSANQTEPLDR

SEQ ID NO: 288 - protein, 197 aa, Artificial Sequence
  synthetic ZmPYLe homologous to AtPYR1 E141Y
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVIYSFVVDVPDGNTKDETCYFVEAVIKCNLNSLAEVSEQLAVESPTSLIDQ

SEQ ID NO: 289 - protein, 197 aa, Artificial Sequence
  synthetic ZmPYLg homologous to AtPYR1 E141Y
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKFVGGDHRLQNYSSIITVHPESIDGRPGTLVIYSFVVDVPDGNTKDETCYFVEAVIKCNLKSLAEVSEQLAVESPTSPIDQ

SEQ ID NO: 290 - protein, 233 aa, Artificial Sequence
  synthetic ZmPYLc homologous to AtPYR1 F61L
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRLIRSCHLVDGDGAEVGSVRELLLVSGLPAESSRERLEIRDDERRVISFRVLGGDHRLANYRSVTTVHEAAPSQDGRPLTMVVESYVVDVPPGNTVEETRIFVDTIVRCNLQSLEGTVIRQLEIAAMPHDDNQN

SEQ ID NO: 291 - protein, 213 aa, Artificial Sequence
  synthetic ZmPYLl homologous to AtPYR1 F61L
MPYAATRTSPQQHSRVASNGRAVAACAGHAGVPDEVARHHEHAVAAGQCCSVMVQSIAAPADAVWSLVRRFDQPQGYKRLIRSCHLVDGDGVEVGSVRELLVVSGLPAENSRERLEIRDDERRVISFRILGGDHRLANYRSVTTVHEAASEGGPLTMVVESYVVDVPPGNTVEETRIFVDTIVRCNLQSLEDTVIRQQAMAAPAAPHNDHNHS

SEQ ID NO: 292 - protein, 200 aa, Artificial Sequence
  synthetic ZmPYLa homologous to AtPYR1 F61L
MPYTAPRPSPQQHSRVLSGGGAKAASHGASCAAVPAEVARHHEHAARAGQCCSAVVQAIAAPVGAVWSVVRRFDRPQAYKHLIRSCRLVGGGDVAVGSVREVRVVSGLPATSSRERLEILDDERRVLSFRVVGGEHRLANYRSVTTVHEAGAGAGTGTVVVESYVVDVPHGNTADETRVFVDTIVRCNLQSLARTAERLA

SEQ ID NO: 293 - protein, 220 aa, Artificial Sequence
  synthetic ZmPYLb homologous to AtPYR1 F61L
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRLVRSCALLAGDGGVGTLREVRVVSGLPAASSRERLEVLDDESHVLSFRVVGGEHRLRNYLSVTTVHPSPAAPDAATVVVESYVVDVPPGNTPEDTRVFVDTIVKCNLQSLATTAEKLAAV

SEQ ID NO: 294 - protein, 218 aa, Artificial Sequence
  synthetic ZmPYLo homologous to AtPYR1 F61L
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRLVRSCALLAGDGGVGTLREVRVVSGLPAASSRERLEVLDDESHVLSFRVVGGEHRLQNYLSVTTVHPSPAAPDAATVVVESYVVDVPPGNTPEDTRVFVDTIVKCNLQSLATTAEKLALAAV

SEQ ID NO: 295 - protein, 212 aa, Artificial Sequence
  synthetic ZmPYLi homologous to AtPYR1 F61L
MDQQGAGGDAEVPAGLGLTAAEYEQLRSTVDAHHRYAVGEGQCSSLLAQRIHAPPEAVWAVVRRFDCPQVYKHLIRSCALRPDPEAGDALCPGRLREVSVISGLPASTSTERLDLLDDAARVFGFSITGGEHRLRNYRSVTTVSELADPAICTVVLESYVVDVPDGNTEDDTRLFADTVIRLNLQKLKSVAEANAAEAAATTNSVLLPRPAE

SEQ ID NO: 296 - protein, 205 aa, Artificial Sequence
  synthetic ZmPYLk homologous to AtPYR1 F61L
MDQQGAGGDVEVPAGLGLTAAEYEQLRPTVDAHHRYAVGEGQCSSLLAQRIHAPPAAVWAIVRRFDCPQVYKHLIRSCAVRPDPDAGDALRPGRLREVCVISGLPASTSTERLDHLDDAARVFGFSITGGEHRLRNYRSVTTVSELAGPGICTVVLESYAVDVPDGNTEDDTRLFADTVIRLNLQKLKSVAEASTSSSAPPPPSE

SEQ ID NO: 297 - protein, 188 aa, Artificial Sequence
  synthetic ZmPYLj homologous to AtPYR1 F61L
MEPHMESALRQGLSEAEQRELEGVVRAHHTFPGRAPGTCTSLVTQRVDAPLAAVWPIVRGFGSPQRYKHLIKSCDLKAGDGATVGSVREVTVVSGLPASTSTERLEILDDHRHILSFRVVGGDHRLRNYRSVTSVTEFQPGPYCVVLESYVVDVPDGNTEEDTRMFTDTVVKLNLQKLAAIATSSSAN

SEQ ID NO: 298 - protein, 214 aa, Artificial Sequence
  synthetic ZmPYLd homologous to AtPYR1 F61L
MVVEMDGGVGVAAAGGGGAQTPAPPPPRRWRLADERCDLRAMETDYVRRFHRHEPRDHQCSSAVAKHIKAPVHLVWSLVRRFDQPQLFKPLVSRCEMKGNIEIGSVREVNVKSGLPATRSTERLELLDDDERILSVRFVGGDHRLQNYSSILSVTEFQPGPYCVVLESYVVDVPDGNTEEDTRMFTDTVVKLNLQKLAAIATSSSANQTEPLDR

SEQ ID NO: 299 - protein, 209 aa, Artificial Sequence
  synthetic ZmPYLf homologous to AtPYR1 F61L
MVMVEMDGGVGGGGGGGQTPAPRRWRLADERCDLRAMETDYVRRFHRHEPREHQCSSAVAKHIKAPVHLVWSLVRRFDQPQLFKPLVSRCEMKGNIEIGSVREVNVKSGLPATRSTERLELLDDNEHILSVRFVGGDHRLQNYSSILSVTEFQPGPYCVVLESYVVDVPDGNTEEDTRMFTDTVVKLNLQKLAAIATSSSANQTEPLDR

SEQ ID NO: 300 - protein, 197 aa, Artificial Sequence
  synthetic ZmPYLe homologous to AtPYR1 F61L
MVGLVGGSTARAEHVVANAGGEAEYVRRMHRHAPTEHQCTSTLVKHIKAPVHLVWELVRRFDQPQRYKPLVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFVEAVIKCNLNSLAEVSEQLAVESPTSLIDQ

SEQ ID NO: 301 - protein, 197 aa, Artificial Sequence
  synthetic ZmPYLg homologous to AtPYR1 F61L
MVGLVGGSTARAEHVVANAGGETEYVRRLHRHAPAEHQCTSTLVKHIKAPVHLVWELVRSFDQPQRYKPLVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFVEAVIKCNLKSLAEVSEQLAVESPTSPIDQ

SEQ ID NO: 302 - protein, 233 aa, Artificial Sequence
  synthetic ZmPYLc homologous to AtPYR1 F61M
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRMIRSCHLVDGDGAEVGSVRELLLVSGLPAESSRERLEIRDDERRVISFRVLGGDHRLANYRSVTTVHEAAPSQDGRPLTMVVESYVVDVPPGNTVEETRIFVDTIVRCNLQSLEGTVIRQLEIAAMPHDDNQN

SEQ ID NO: 303 - protein, 213 aa, Artificial Sequence
  synthetic ZmPYLl homologous to AtPYR1 F61M
MPYAATRTSPQQHSRVASNGRAVAACAGHAGVPDEVARHHEHAVAAGQCCSVMVQSIAAPADAVWSLVRRFDQPQGYKRMIRSCHLVDGDGVEVGSVRELLVVSGLPAENSRERLEIRDDERRVISFRILGGDHRLANYRSVTTVHEAASEGGPLTMVVESYVVDVPPGNTVEETRIFVDTIVRCNLQSLEDTVIRQQAMAAPAAPHNDHNHS

SEQ ID NO: 304 - protein, 200 aa, Artificial Sequence
  synthetic ZmPYLa homologous to AtPYR1 F61M
MPYTAPRPSPQQHSRVLSGGGAKAASHGASCAAVPAEVARHHEHAARAGQCCSAVVQAIAAPVGAVWSVVRRFDRPQAYKHMIRSCRLVGGGDVAVGSVREVRVVSGLPATSSRERLEILDDERRVLSFRVVGGEHRLANYRSVTTVHEAGAGAGTGTVVVESYVVDVPHGNTADETRVFVDTIVRCNLQSLARTAERLA

SEQ ID NO: 305 - protein, 220 aa, Artificial Sequence
  synthetic ZmPYLb homologous to AtPYR1 F61M
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRMVRSCALLAGDGGVGTLREVRVVSGLPAASSRERLEVLDDESHVLSFRVVGGEHRLRNYLSVTTVHPSPAAPDAATVVVESYVVDVPPGNTPEDTRVFVDTIVKCNLQSLATTAEKLAAV

SEQ ID NO: 306 - protein, 218 aa, Artificial Sequence
  synthetic ZmPYLo homologous to AtPYR1 F61M
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRMVRSCALLAGDGGVGTLREVRVVSGLPAASSRERLEVLDDESHVLSFRVVGGEHRLQNYLSVTTVHPSPAAPDAATVVVESYVVDVPPGNTPEDTRVFVDTIVKCNLQSLATTAEKLALAAV

SEQ ID NO: 307 - protein, 212 aa, Artificial Sequence
  synthetic ZmPYLi homologous to AtPYR1 F61M
MDQQGAGGDAEVPAGLGLTAAEYEQLRSTVDAHHRYAVGEGQCSSLLAQRIHAPPEAVWAVVRRFDCPQVYKHMIRSCALRPDPEAGDALCPGRLREVSVISGLPASTSTERLDLLDDAARVFGFSITGGEHRLRNYRSVTTVSELADPAICTVVLESYVVDVPDGNTEDDTRLFADTVIRLNLQKLKSVAEANAAEAAATTNSVLLPRPAE

SEQ ID NO: 308 - protein, 205 aa, Artificial Sequence
  synthetic ZmPYLk homologous to AtPYR1 F61M
MDQQGAGGDVEVPAGLGLTAAEYEQLRPTVDAHHRYAVGEGQCSSLLAQRIHAPPAAVWAIVRRFDCPQVYKHMIRSCAVRPDPDAGDALRPGRLREVCVISGLPASTSTERLDHLDDAARVFGFSITGGEHRLRNYRSVTTVSELAGPGICTVVLESYAVDVPDGNTEDDTRLFADTVIRLNLQKLKSVAEASTSSSAPPPPSE

SEQ ID NO: 309 - protein, 188 aa, Artificial Sequence
  synthetic ZmPYLj homologous to AtPYR1 F61M
MEPHMESALRQGLSEAEQRELEGVVRAHHTFPGRAPGTCTSLVTQRVDAPLAAVWPIVRGFGSPQRYKHMIKSCDLKAGDGATVGSVREVTVVSGLPASTSTERLEILDDHRHILSFRVVGGDHRLRNYRSVTSVTEFQPGPYCVVLESYVVDVPDGNTEEDTRMFTDTVVKLNLQKLAAIATSSSAN

SEQ ID NO: 310 - protein, 214 aa, Artificial Sequence
  synthetic ZmPYLd homologous to AtPYR1 F61M
MVVEMDGGVGVAAAGGGGAQTPAPPPPRRWRLADERCDLRAMETDYVRRFHRHEPRDHQCSSAVAKHIKAPVHLVWSLVRRFDQPQLFKPMVSRCEMKGNIEIGSVREVNVKSGLPATRSTERLELLDDDERILSVRFVGGDHRLQNYSSILSVTEFQPGPYCVVLESYVVDVPDGNTEEDTRMFTDTVVKLNLQKLAAIATSSSANQTEPLDR

SEQ ID NO: 311 - protein, 209 aa, Artificial Sequence
  synthetic ZmPYLf homologous to AtPYR1 F61M
MVMVEMDGGVGGGGGGGQTPAPRRWRLADERCDLRAMETDYVRRFHRHEPREHQCSSAVAKHIKAPVHLVWSLVRRFDQPQLFKPMVSRCEMKGNIEIGSVREVNVKSGLPATRSTERLELLDDNEHILSVRFVGGDHRLQNYSSILSVTEFQPGPYCVVLESYVVDVPDGNTEEDTRMFTDTVVKLNLQKLAAIATSSSANQTEPLDR

SEQ ID NO: 312 - protein, 197 aa, Artificial Sequence
  synthetic ZmPYLe homologous to AtPYR1 F61M
MVGLVGGSTARAEHVVANAGGEAEYVRRMHRHAPTEHQCTSTLVKHIKAPVHLVWELVRRFDQPQRYKPMVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFVEAVIKCNLNSLAEVSEQLAVESPTSLIDQ

SEQ ID NO: 313 - protein, 197 aa, Artificial Sequence
  synthetic ZmPYLg homologous to AtPYR1 F61M
MVGLVGGSTARAEHVVANAGGETEYVRRLHRHAPAEHQCTSTLVKHIKAPVHLVWELVRSFDQPQRYKPMVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFVEAVIKCNLKSLAEVSEQLAVESPTSPIDQ

SEQ ID NO: 314 - protein, 233 aa, Artificial Sequence
  synthetic ZmPYLc homologous to AtPYR1 I110C
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRCLGGDHRLANYRSVTTVHEAAPSQDGRPLTMVVESYVVDVPPGNTVEETRIFVDTIVRCNLQSLEGTVIRQLEIAAMPHDDNQN

SEQ ID NO: 315 - protein, 213 aa, Artificial Sequence
  synthetic ZmPYLl homologous to AtPYR1 I110C
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRCLGGDHRLANYRSVTTVHEAASEGGPLTMVVESYVVDVPPGNTVEETRIFVDTIVRCNLQSLEDTVIRQQAMAAPAAPHNDHNHS

SEQ ID NO: 316 - protein, 200 aa, Artificial Sequence
  synthetic ZmPYLa homologous to AtPYR1 I110C
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRCVGGEHRLANYRSVTTVHEAGAGAGTGTVVVESYVVDVPHGNTADETRVFVDTIVRCNLQSLARTAERLA

SEQ ID NO: 317 - protein, 220 aa, Artificial Sequence
  synthetic ZmPYLb homologous to AtPYR1 I110C
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRCVGGEHRLRNYLSVTTVHPSPAAPDAATVVVESYVVDVPPGNTPEDTRVFVDTIVKCNLQSLATTAEKLAAV

SEQ ID NO: 318 - protein, 218 aa, Artificial Sequence
  synthetic ZmPYLo homologous to AtPYR1 I110C
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRCVGGEHRLQNYLSVTTVHPSPAAPDAATVVVESYVVDVPPGNTPEDTRVFVDTIVKCNLQSLATTAEKLALAAV

SEQ ID NO: 319 - protein, 212 aa, Artificial Sequence
  synthetic ZmPYLi homologous to AtPYR1 I110C
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSCTGGEHRLRNYRSVTTVSELADPAICTVVLESYVVDVPDGNTEDDTRLFADTVIRLNLQKLKSVAEANAAEAAATTNSVLLPRPAE

SEQ ID NO: 320 - protein, 205 aa, Artificial Sequence
  synthetic ZmPYLk homologous to AtPYR1 I110C
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSCTGGEHRLRNYRSVTTVSELAGPGICTVVLESYAVDVPDGNTEDDTRLFADTVIRLNLQKLKSVAEASTSSSAPPPPSE

SEQ ID NO: 321 - protein, 188 aa, Artificial Sequence
  synthetic ZmPYLj homologous to AtPYR1 I110C
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRCVGGDHRLRNYRSVTSVTEFQPGPYCVVLESYVVDVPDGNTEEDTRMFTDTVVKLNLQKLAAIATSSSAN

SEQ ID NO: 322 - protein, 214 aa, Artificial Sequence
  synthetic ZmPYLd homologous to AtPYR1 I110C
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRCVGGDHRLQNYSSILSVTEFQPGPYCVVLESYVVDVPDGNTEEDTRMFTDTVVKLNLQKLAAIATSSSANQTEPLDR

SEQ ID NO: 323 - protein, 209 aa, Artificial Sequence
  synthetic ZmPYLf homologous to AtPYR1 I110C
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRCVGGDHRLQNYSSILSVTEFQPGPYCVVLESYVVDVPDGNTEEDTRMFTDTVVKLNLQKLAAIATSSSANQTEPLDR

SEQ ID NO: 324 - protein, 197 aa, Artificial Sequence
  synthetic ZmPYLe homologous to AtPYR1 I110C
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKCVGGDHRLQNYSSIITVHPESIDGRPGTLVIESFVVDVPDGNTKDETCYFVEAVIKCNLNSLAEVSEQLAVESPTSLIDQ

SEQ ID NO: 325 - protein, 197 aa, Artificial Sequence
  synthetic ZmPYLg homologous to AtPYR1 I110C
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKCVGGDHRLQNYSSIITVHPESIDGRPGTLVIESFVVDVPDGNTKDETCYFVEAVIKCNLKSLAEVSEQLAVESPTSPIDQ

SEQ ID NO: 326 - protein, 233 aa, Artificial Sequence
  synthetic ZmPYLc homologous to AtPYR1 I110S
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRSLGGDHRLANYRSVTTVHEAAPSQDGRPLTMVVESYVVDVPPGNTVEETRIFVDTIVRCNLQSLEGTVIRQLEIAAMPHDDNQN

SEQ ID NO: 327 - protein, 213 aa, Artificial Sequence
  synthetic ZmPYLl homologous to AtPYR1 I110S
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRSLGGDHRLANYRSVTTVHEAASEGGPLTMVVESYVVDVPPGNTVEETRIFVDTIVRCNLQSLEDTVIRQQAMAAPAAPHNDHNHS

SEQ ID NO: 328 - protein, 200 aa, Artificial Sequence
  synthetic ZmPYLa homologous to AtPYR1 I110S
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRSVGGEHRLANYRSVTTVHEAGAGAGTGTVVVESYVVDVPHGNTADETRVFVDTIVRCNLQSLARTAERLA

SEQ ID NO: 329 - protein, 220 aa, Artificial Sequence
  synthetic ZmPYLb homologous to AtPYR1 I110S
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREVRVVSGLPAASSRERLEVLDDESHVLSFRSVGGEHRLRNYLSVTTVHPSPAAPDAATVVVESYVVDVPPGNTPEDTRVFVDTIVKCNLQSLATTAEKLAAV

SEQ ID NO: 330 - protein, 218 aa, Artificial Sequence
  synthetic ZmPYLo homologous to AtPYR1 I110S
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRSVGGEHRLQNYLSVTTVHPSPAAPDAATVVVESYVVDVPPGNTPEDTRVFVDTIVKCNLQSLATTAEKLALAAV

SEQ ID NO: 331 - protein, 212 aa, Artificial Sequence
  synthetic ZmPYLi homologous to AtPYR1 I110S
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSSTGGEHRLRNYRSVTTVSELADPAICTVVLESYVVDVPDGNTEDDTRLFADTVIRLNLQKLKSVAEANAAEAAATTNSVLLPRPAE

SEQ ID NO: 332 - protein, 205 aa, Artificial Sequence
  synthetic ZmPYLk homologous to AtPYR1 I110S
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREVCVISGLPASTSTERLDHLDDAARVFGFSSTGGEHRLRNYRSVTTVSELAGPGICTVVLESYAVDVPDGNTEDDTRLFADTVIRLNLQKLKSVAEASTSSSAPPPPSE

SEQ ID NO: 333 - protein, 188 aa, Artificial Sequence
  synthetic ZmPYLj homologous to AtPYR1 I110S
MEPHMESALRQGLSEAEQRELEGVVRAHHTFPGRAPGTCTSLVTQRVDAPLAAVWPIVRGFGSPQRYKHFIKSCDLKAGDGATVGSVREVTVVSGLPASTSTERLEILDDHRHILSFRSVGGDHRLRNYRSVTSVTEFQPGPYCVVLESYVVDVPDGNTEEDTRMFTDTVVKLNLQKLAAIATSSSAN

SEQ ID NO: 334 - protein, 214 aa, Artificial Sequence
  synthetic ZmPYLd homologous to AtPYR1 I110S
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREVNVKSGLPATRSTERLELLDDDERILSVRSVGGDHRLQNYSSILSVTEFQPGPYCVVLESYVVDVPDGNTEEDTRMFTDTVVKLNLQKLAAIATSSSANQTEPLDR

SEQ ID NO: 335 - protein, 209 aa, Artificial Sequence
  synthetic ZmPYLf homologous to AtPYR1 I110S
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREVNVKSGLPATRSTERLELLDDNEHILSVRSVGGDHRLQNYSSILSVTEFQPGPYCVVLESYVVDVPDGNTEEDTRMFTDTVVKLNLQKLAAIATSSSANQTEPLDR

SEQ ID NO: 336 - protein, 197 aa, Artificial Sequence
  synthetic ZmPYLe homologous to AtPYR1 I110S
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKSVGGDHRLQNYSSIITVHPESIDGRPGTLVIESFVVDVPDGNTKDETCYFVEAVIKCNLNSLAEVSEQLAVESPTSLIDQ

SEQ ID NO: 337 - protein, 197 aa, Artificial Sequence
  synthetic ZmPYLg homologous to AtPYR1 I110S
MVGLVGGSTARAEHVVANAGGETEYVRRLHRHAPAEHQCTSTLVKHIKAPVHLVWELVRSFDQPQRYKPFVRNCVVRGDQLEVGSLRDVNVKTGLPATTSTERLEQLDDDLHILGVKSVGGDHRLQNYSSIITVHPESIDGRPGTLVIESFVVDVPDGNTKDETCYFVEAVIKCNLKSLAEVSEQLAVESPTSPIDQ

SEQ ID NO: 338 - protein, 233 aa, Artificial Sequence
  synthetic ZmPYLc homologous to AtPYR1 V81I
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVREILLVSGLPAESSRERLEIRDDERRVISFRVLGGDHRLANYRSVTTVHEAAPSQDGRPLTMVVESYVVDVPPGNTVEETRIFVDTIVRCNLQSLEGTVIRQLEIAAMPHDDNQN

SEQ ID NO: 339 - protein, 213 aa, Artificial Sequence
  synthetic ZmPYLl homologous to AtPYR1 V81I
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVREILVVSGLPAENSRERLEIRDDERRVISFRILGGDHRLANYRSVTTVHEAASEGGPLTMVVESYVVDVPPGNTVEETRIFVDTIVRCNLQSLEDTVIRQQAMAAPAAPHNDHNHS

SEQ ID NO: 340 - protein, 200 aa, Artificial Sequence
  synthetic ZmPYLa homologous to AtPYR1 V81I
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREIRVVSGLPATSSRERLEILDDERRVLSFRVVGGEHRLANYRSVTTVHEAGAGAGTGTVVVESYVVDVPHGNTADETRVFVDTIVRCNLQSLARTAERLA

SEQ ID NO: 341 - protein, 220 aa, Artificial Sequence
  synthetic ZmPYLb homologous to AtPYR1 V81I
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREIRVVSGLPAASSRERLEVLDDESHVLSFRVVGGEHRLRNYLSVTTVHPSPAAPDAATVVVESYVVDVPPGNTPEDTRVFVDTIVKCNLQSLATTAEKLAAV

SEQ ID NO: 342 - protein, 218 aa, Artificial Sequence
  synthetic ZmPYLo homologous to AtPYR1 V81I
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREIRVVSGLPAASSRERLEVLDDESHVLSFRVVGGEHRLQNYLSVTTVHPSPAAPDAATVVVESYVVDVPPGNTPEDTRVFVDTIVKCNLQSLATTAEKLALAAV

SEQ ID NO: 343 - protein, 212 aa, Artificial Sequence
  synthetic ZmPYLi homologous to AtPYR1 V81I
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREISVISGLPASTSTERLDLLDDAARVFGFSITGGEHRLRNYRSVTTVSELADPAICTVVLESYVVDVPDGNTEDDTRLFADTVIRLNLQKLKSVAEANAAEAAATTNSVLLPRPAE

SEQ ID NO: 344 - protein, 205 aa, Artificial Sequence
  synthetic ZmPYLk homologous to AtPYR1 V81I
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREICVISGLPASTSTERLDHLDDAARVFGFSITGGEHRLRNYRSVTTVSELAGPGICTVVLESYAVDVPDGNTEDDTRLFADTVIRLNLQKLKSVAEASTSSSAPPPPSE

SEQ ID NO: 345 - protein, 188 aa, Artificial Sequence
  synthetic ZmPYLj homologous to AtPYR1 V81I
MEPHMESALRQGLSEAEQRELEGVVRAHHTFPGRAPGTCTSLVTQRVDAPLAAVWPIVRGFGSPQRYKHFIKSCDLKAGDGATVGSVREITVVSGLPASTSTERLEILDDHRHILSFRVVGGDHRLRNYRSVTSVTEFQPGPYCVVLESYVVDVPDGNTEEDTRMFTDTVVKLNLQKLAAIATSSSAN

SEQ ID NO: 346 - protein, 214 aa, Artificial Sequence
  synthetic ZmPYLd homologous to AtPYR1 V81I
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREINVKSGLPATRSTERLELLDDDERILSVRFVGGDHRLQNYSSILSVTEFQPGPYCVVLESYVVDVPDGNTEEDTRMFTDTVVKLNLQKLAAIATSSSANQTEPLDR

SEQ ID NO: 347 - protein, 213 aa, Artificial Sequence
  synthetic ZmPYLf homologous to AtPYR1 V81I
ZMPYMVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREINVKSGLPATRSTERLELLDDNEHILSVRFVGGDHRLQNYSSILSVTEFQPGPYCVVLESYVVDVPDGNTEEDTRMFTDTVVKLNLQKLAAIATSSSANQTEPLDR

SEQ ID NO: 348 - protein, 197 aa, Artificial Sequence
  synthetic ZmPYLe homologous to AtPYR1 V81I
MVGLVGGSTARAEHVVANAGGEAEYVRRMHRHAPTEHQCTSTLVKHIKAPVHLVWELVRRFDQPQRYKPFVRNCVVRGDQLEVGSLRDINVKTGLPATTSTERLEQLDDDLHILGVKFVGGDHRLQNYSSIITVHPESIDGRPGTLVIESFVVDVPDGNTKDETCYFVEAVIKCNLNSLAEVSEQLAVESPTSLIDQ

SEQ ID NO: 349 - protein, 197 aa, Artificial Sequence
  synthetic ZmPYLg homologous to AtPYR1 V81I
MVGLVGGSTARAEHVVANAGGETEYVRRLHRHAPAEHQCTSTLVKHIKAPVHLVWELVRSFDQPQRYKPFVRNCVVRGDQLEVGSLRDINVKTGLPATTSTERLEQLDDDLHILGVKFVGGDHRLQNYSSIITVHPESIDGRPGTLVIESFVVDVPDGNTKDETCYFVEAVIKCNLKSLAEVSEQLAVESPTSPIDQ

SEQ ID NO: 350 - protein, 233 aa, Artificial Sequence
  synthetic ZmPYLc homologous to AtPYR1 V81Y
MRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVREYLLVSGLPAESSRERLEIRDDERRVISFRVLGGDHRLANYRSVTTVHEAAPSQDGRPLTMVVESYVVDVPPGNTVEETRIFVDTIVRCNLQSLEGTVIRQLEIAAMPHDDNQN

SEQ ID NO: 351 - protein, 213 aa, Artificial Sequence
  synthetic ZmPYLl homologous to AtPYR1 V81Y
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVREYLVVSGLPAENSRERLEIRDDERRVISFRILGGDHRLANYRSVTTVHEAASEGGPLTMVVESYVVDVPPGNTVEETRIFVDTIVRCNLQSLEDTVIRQQAMAAPAAPHNDHNHS

SEQ ID NO: 352 - protein, 200 aa, Artificial Sequence
  synthetic ZmPYLa homologous to AtPYR1 V81Y
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREYRVVSGLPATSSRERLEILDDERRVLSFRVVGGEHRLANYRSVTTVHEAGAGAGTGTVVVESYVVDVPHGNTADETRVFVDTIVRCNLQSLARTAERLA

SEQ ID NO: 353 - protein, 220 aa, Artificial Sequence
  synthetic ZmPYLb homologous to AtPYR1 V81Y
MPCIQASSPGGMPHQHGRGRVLGGGVGCAAEVAAAVAASAGGMRCGAHDGEVPAEAARHHEHAAAGPGRCCSAVVQHVAAPAAAVWSVVRRFDQPQVYKRFVRSCALLAGDGGVGTLREYRVVSGLPAASSRERLEVLDDESHVLSFRVVGGEHRLRNYLSVTTVHPSPAAPDAATVVVESYVVDVPPGNTPEDTRVFVDTIVKCNLQSLATTAEKLAAV

SEQ ID NO: 354 - protein, 218 aa, Artificial Sequence
  synthetic ZmPYLo homologous to AtPYR1 V81Y
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREYRVVSGLPAASSRERLEVLDDESHVLSFRVVGGEHRLQNYLSVTTVHPSPAAPDAATVVVESYVVDVPPGNTPEDTRVFVDTIVKCNLQSLATTAEKLALAAV

SEQ ID NO: 355 - protein, 212 aa, Artificial Sequence
  synthetic ZmPYLi homologous to AtPYR1 V81Y
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREYSVISGLPASTSTERLDLLDDAARVFGFSITGGEHRLRNYRSVTTVSELADPAICTVVLESYVVDVPDGNTEDDTRLFADTVIRLNLQKLKSVAEANAAEAAATTNSVLLPRPAE

SEQ ID NO: 356 - protein, 205 aa, Artificial Sequence
  synthetic ZmPYLk homologous to AtPYR1 V81Y
MDQQGAGGDVEVPAGLGLTAAEYEQLRPTVDAHHRYAVGEGQCSSLLAQRIHAPPAAVWAIVRRFDCPQVYKHFIRSCAVRPDPDAGDALRPGRLREYCVISGLPASTSTERLDHLDDAARVFGFSITGGEHRLRNYRSVTTVSELAGPGICTVVLESYAVDVPDGNTEDDTRLFADTVIRLNLQKLKSVAEASTSSSAPPPPSE

SEQ ID NO: 357 - protein, 188 aa, Artificial Sequence
  synthetic ZmPYLj homologous to AtPYR1 V81Y
MEPHMESALRQGLSEAEQRELEGVVRAHHTFPGRAPGTCTSLVTQRVDAPLAAVWPIVRGFGSPQRYKHFIKSCDLKAGDGATVGSVREYTVVSGLPASTSTERLEILDDHRHILSFRVVGGDHRLRNYRSVTSVTEFQPGPYCVVLESYVVDVPDGNTEEDTRMFTDTVVKLNLQKLAAIATSSSAN

SEQ ID NO: 358 - protein, 214 aa, Artificial Sequence
  synthetic ZmPYLd homologous to AtPYR1 V81Y
MVVEMDGGVGVAAAGGGGAQTPAPPPPRRWRLADERCDLRAMETDYVRRFHRHEPRDHQCSSAVAKHIKAPVHLVWSLVRRFDQPQLFKPFVSRCEMKGNIEIGSVREYNVKSGLPATRSTERLELLDDDERILSVRFVGGDHRLQNYSSILSVTEFQPGPYCVVLESYVVDVPDGNTEEDTRMFTDTVVKLNLQKLAAIATSSSANQTEPLDR

SEQ ID NO: 359 - protein, 209 aa, Artificial Sequence
  synthetic ZmPYLf homologous to AtPYR1 V81Y
MVMVEMDGGVGGGGGGGQTPAPRRWRLADERCDLRAMETDYVRRFHRHEPREHQCSSAVAKHIKAPVHLVWSLVRRFDQPQLFKPFVSRCEMKGNIEIGSVREYNVKSGLPATRSTERLELLDDNEHILSVRFVGGDHRLQNYSSILSVTEFQPGPYCVVLESYVVDVPDGNTEEDTRMFTDTVVKLNLQKLAAIATSSSANQTEPLDR

SEQ ID NO: 360 - protein, 197 aa, Artificial Sequence
  synthetic ZmPYLe homologous to AtPYR1 V81Y
MVGLVGGSTARAEHVVANAGGEAEYVRRMHRHAPTEHQCTSTLVKHIKAPVHLVWELVRRFDQPQRYKPFVRNCVVRGDQLEVGSLRDYNVKTGLPATTSTERLEQLDDDLHILGVKFVGGDHRLQNYSSIITVHPESIDGRPGTLVIESFVVDVPDGNTKDETCYFVEAVIKCNLNSLAEVSEQLAVESPTSLIDQ

SEQ ID NO: 361 - protein, 197 aa, Artificial Sequence
  synthetic ZmPYLg homologous to AtPYR1 V81Y
MVGLVGGSTARAEHVVANAGGETEYVRRLHRHAPAEHQCTSTLVKHIKAPVHLVWELVRSFDQPQRYKPFVRNCVVRGDQLEVGSLRDYNVKTGLPATTSTERLEQLDDDLHILGVKFVGGDHRLQNYSSIITVHPESIDGRPGTLVIESFVVDVPDGNTKDETCYFVEAVIKCNLKSLAEVSEQLAVESPTSPIDQ

SEQ ID NO: 362 - DNA, 20 bp, Artificial Sequence
  synthetic ZmPYL-E genomic target sequence
cgcgacgtcaacgtcaagac

SEQ ID NO: 363 - RNA, 17 nt, Artificial Sequence
  synthetic gRNA nucleotide sequence
gacgucaacgucaagac

SEQ ID NO: 364 - RNA, 18 nt, Artificial Sequence
  synthetic gRNA nucleotide sequence
cgacgucaacgucaagac

SEQ ID NO: 365 - RNA, 19 nt, Artificial Sequence
  synthetic gRNA nucleotide sequence
gcgacgucaacgucaagac

SEQ ID NO: 366 - RNA, 20 nt, Artificial Sequence
  synthetic gRNA nucleotide sequence
cgcgacgucaacgucaagac

SEQ ID NO: 367 - RNA, 21 nt, Artificial Sequence
  synthethic gRNA nucleotide sequence
gcgcgacgucaacgucaagac

SEQ ID NO: 368 - DNA, 30 bp, Artificial Sequence
  synthetic maize ZmPYL-E genomic nucleotide sequence
gcaccctggtgatcgagtcgttcgtggtcg

SEQ ID NO: 369 - DNA, 20 bp, Artificial Sequence
  synthetic xZmPYLE-E149L sequence
cctggtgatcctgtcgttcg

SEQ ID NO: 370 - DNA, 76 bp, Artificial Sequence
  synthetic tracRNA scaffold sequence
gttttagagctagaaatagcaagttaaaataaggctagtccgttatcaacttgaaaaagtggcaccgagtcggtgc

SEQ ID NO: 371 - DNA, 480 bp, Artificial Sequence
  synthetic expression cassette sequence
gggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcagcgacgtcaacgtcaagacgttttagagctagaaatagcaagttaaaataaggctagtccgttatcaacttgaaaaagtggcaccgagtcggtgcttttttttt

SEQ ID NO: 372 - DNA, 622 bp, Artificial Sequence
  synthetic expression cassette sequence
tttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagcttgcgcgacgtcaacgtcaagacgttttagagctagaaatagcaagttaaaataaggctagtccgttatcaacttgaaaaagtggcaccgagtcggtgcttttttttt

SEQ ID NO: 373 - DNA, 622 bp, Artificial Sequence
  synthetic expression cassette sequence with SEQ ID NO:369 target sequence
tttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagcttgcctggtgatcgagtcgttcggttttagagctagaaatagcaagttaaaataaggctagtccgttatcaacttgaaaaagtggcaccgagtcggtgcttttttttt

SEQ ID NO: 374 - DNA, 481 bp, Artificial Sequence
  synthetic expression cassette sequence with SEQ ID NO:369 target sequence
gggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcacctggtgatcgagtcgttcggttttagagctagaaatagcaagttaaaataaggctagtccgttatcaacttgaaaaagtggcaccgagtcggtgcttttttttt

SEQ ID NO: 375 - DNA, 40 bp, Artificial Sequence
  synthetic repair DNA sequence
gcagcctgcgcgacgccaacgtcaagaccggcctgccggc

SEQ ID NO: 376 - DNA, 50 bp, Artificial Sequence
  synthetic repair DNA sequence
ggtcggcagcctgcgcgacgccaacgtcaagaccggcctgccggcgacga

SEQ ID NO: 377 - DNA, 70 bp, Artificial Sequence
  synthetic repair DNA sequence
accagctcgaggtcggcagcctgcgcgacgccaacgtcaagaccggcctgccggcgacgaccagaaccga

SEQ ID NO: 378 - DNA, 111 bp, Artificial Sequence
  synthetic repair DNA sequence
gaactgcgtcgtgcgcggggaccagctcgaggtcggcagcctgcgcgacgccaacgtcaagaccggcctgccggcgacgaccagaaccgagcgcctcgagcagctcgacga

SEQ ID NO: 379 - DNA, 60 bp, Artificial Sequence
  synthetic repair donor oligonucleotide sequence
tgacgggaggccgggcaccctggtgatcctgtcgttcgtagtcgatgtgcctgatggcaa

SEQ ID NO: 380 - DNA, 72 bp, Artificial Sequence
  synthetic repair donor oligonucleotide sequence
  misc_feature (1)..(4): phosphorothioate linkage between nucleotides
  misc_feature (69)..(72): phosphorothioate linkage between nucleotides
ttcgtgttgccatcaggcacatcgactacgaacgacaggatcaccagggtgcccggcctcccgtcaatgctc

SEQ ID NO: 381 - DNA, 41 bp, Artificial Sequence
  synthetic repair DNA sequence
ggcagcctgcgcgacatcaacgtcaagaccggcctgccggc

SEQ ID NO: 382 - DNA, 51 bp, Artificial Sequence
  synthetic repair DNA sequence
aggtcggcagcctgcgcgacatcaacgtcaagaccggcctgccggcgacga

SEQ ID NO: 383 - DNA, 71 bp, Artificial Sequence
  synthetic repair DNA sequence
gaccagctcgaggtcggcagcctgcgcgacatcaacgtcaagaccggcctgccggcgacgaccagaaccga

SEQ ID NO: 384 - DNA, 112 bp, Artificial Sequence
  synthetic repair DNA sequence
ggaactgcgtcgtgcgcggggaccagctcgaggtcggcagcctgcgcgacatcaacgtcaagaccggcctgccggcgacgaccagaaccgagcgcctcgagcagctcgacga

SEQ ID NO: 385 - DNA, 41 bp, Artificial Sequence
  synthetic repair DNA sequence
ggcagcctgcgcgactacaacgtcaagaccggcctgccggc

SEQ ID NO: 386 - DNA, 51 bp, Artificial Sequence
  synthetic repair DNA sequence
aggtcggcagcctgcgcgactacaacgtcaagaccggcctgccggcgacga

SEQ ID NO: 387 - DNA, 71 bp, Artificial Sequence
  synthetic repair DNA sequence
gaccagctcgaggtcggcagcctgcgcgactacaacgtcaagaccggcctgccggcgacgaccagaaccga

SEQ ID NO: 388 - DNA, 112 bp, Artificial Sequence
  synthetic repair DNA sequence
ggaactgcgtcgtgcgcggggaccagctcgaggtcggcagcctgcgcgactacaacgtcaagaccggcctgccggcgacgaccagaaccgagcgcctcgagcagctcgacga

SEQ ID NO: 389 - protein, 197 aa, Artificial Sequence
  synthetic PYR/PYL receptor polypeptide comprising subtitution V89A in PYL-E
MVGLVGGSTARAEHVVANAGGEAEYVRRMHRHAPTEHQCTSTLVKHIKAPVHLVWELVRRFDQPQRYKPFVRNCVVRGDQLEVGSLRDANVKTGLPATTSTERLEQLDDDLHILGVKFVGGDHRLQNYSSIITVHPESIDGRPGTLVIESFVVDVPDGNTKDETCYFVEAVIKCNLNSLAEVSEQLAVESPTSLIDQ

SEQ ID NO: 390 - protein, 197 aa, Artificial Sequence
  synthetic PYR/PYL receptor polypeptide comprising substitutions V89A and E149L in PYL-E
MVGLVGGSTARAEHVVANAGGEAEYVRRMHRHAPTEHQCTSTLVKHIKAPVHLVWELVRRFDQPQRYKPFVRNCVVRGDQLEVGSLRDANVKTGLPATTSTERLEQLDDDLHILGVKFVGGDHRLQNYSSIITVHPESIDGRPGTLVILSFVVDVPDGNTKDETCYFVEAVIKCNLNSLAEVSEQLAVESPTSLIDQ

SEQ ID NO: 391 - protein, 197 aa, Artificial Sequence
  synthetic PYR/PYL receptor polypeptide comprising substitutions V89I and E149L in PYL-E
MVGLVGGSTARAEHVVANAGGEAEYVRRMHRHAPTEHQCTSTLVKHIKAPVHLVWELVRRFDQPQRYKPFVRNCVVRGDQLEVGSLRDINVKTGLPATTSTERLEQLDDDLHILGVKFVGGDHRLQNYSSIITVHPESIDGRPGTLVILSFVVDVPDGNTKDETCYFVEAVIKCNLNSLAEVSEQLAVESPTSLIDQ

SEQ ID NO: 392 - protein, 197 aa, Artificial Sequence
  synthetic PYR/PYL receptor polypeptide comprising substitutions V89Y and E149L in PYL-E
MVGLVGGSTARAEHVVANAGGEAEYVRRMHRHAPTEHQCTSTLVKHIKAPVHLVWELVRRFDQPQRYKPFVRNCVVRGDQLEVGSLRDYNVKTGLPATTSTERLEQLDDDLHILGVKFVGGDHRLQNYSSIITVHPESIDGRPGTLVILSFVVDVPDGNTKDETCYFVEAVIKCNLNSLAEVSEQLAVESPTSLIDQ

SEQ ID NO: 393 - DNA, 20 bp, Artificial Sequence
  synthetic gRNA target sequence
gtcggggacgtcgacgacga

SEQ ID NO: 394 - DNA, 20 bp, Artificial Sequence
  synthetic gRNA target sequence
gaggtcatcgacggccggcc

SEQ ID NO: 395 - DNA, 23 bp, Artificial Sequence
  synthetic gRNA target sequence
gctcgtgatcgagtccttcgtgg

SEQ ID NO: 396 - DNA, 20 bp, Artificial Sequence
  synthetic gRNA target sequence
gctcgtgatcgagtccttcg

SEQ ID NO: 397 - DNA, 20 bp, Artificial Sequence
  synthetic gRNA target sequence
cgtcgacgacgtaggactcg

SEQ ID NO: 398 - skipped

SEQ ID NO: 399 - DNA, 75 bp, Artificial Sequence
  synthetic repair donor DNA oligonucleotide
ccttggtgttgccgtcggggacgtcgacgacgaatgacaggatgacgagcgtccctggccggccgtcgatgacct

SEQ ID NO: 400 - DNA, 75 bp, Artificial Sequence; identical to SEQ ID NO: 399
  synthetic repair donor DNA oligonucleotide
  misc_feature (1)..(4): phosphorothioate linkage between nucleotides
  misc_feature (72)..(75): phosphorothioate linkage between nucleotides

SEQ ID NO: 401 - DNA, 88 bp, Artificial Sequence
  synthetic repair donor DNA oligonucleotide
ccatcctcaccgtccacccggaggtcatcgacggccgaccagggacgctcgtcatcctgtccttcgtcgtcgacgtccccgacggcaa

SEQ ID NO: 402 - DNA, 60 bp, Artificial Sequence
  synthetic repair donor DNA oligonucleotide
cgacggccgaccggggacgctcgtgatcctgtccttcgtggtggacgtccccgacggcaa

SEQ ID NO: 403 - DNA, 60 bp, Artificial Sequence
  synthetic repair donor DNA oligonucleotide
cgacggccgaccggggacgctcgtgatcctgtccttcgtagtggacgtccccgacggcaa

SEQ ID NO: 404 - DNA, 77 bp, Artificial Sequence
  synthetic repair donor DNA oligonucleotide
aggtcatcgacggccgaccggggacgctcgtgatcctgtccttcgtagtggacgtccccgacggcaacaccaaggac

SEQ ID NO: 405 - DNA, 77 bp, Artificial Sequence
  synthetic repair donor DNA oligonucleotide
gtccttggtgttgccgtcggggacgtccactacgaaggacaggatcacgagcgtccccggtcggccgtcgatgacct

SEQ ID NO: 406 - DNA, 77 bp, Artificial Sequence; identical to SEQ ID NO: 405
  synthetic repair donor DNA oligonucleotide
  misc_feature (1)..(4): phosphorothioate linkage between nucleotides
  misc_feature (74)..(77): phosphorothioate linkage between nucleotides

SEQ ID NO: 407 - DNA, 68 bp, Artificial Sequence
  synthetic repair donor DNA oligonucleotide
caccgagttccagccgggcccctactgcgtcgtgctcctgtcctacgtcgtcgacgtccccgacggca

SEQ ID NO: 408 - DNA, 68 bp, Artificial Sequence
  synthetic repair donor DNA oligonucleotide
tgccgtcggggacgtcgacgacgtaggacaggagcacgacgcagtaggggcccggctggaactcggtg

SEQ ID NO: 409 - DNA, 68 bp, Artificial Sequence; identical to SEQ ID NO: 408
  synthetic repair donor DNA oligonucleotide
  misc_feature (1)..(4): phosphorothioate linkage between nucleotides
  misc_feature (65)..(68): phosphorothioate linkage between nucleotides

SEQ ID NO: 410 - DNA, 88 bp, Artificial Sequence
  synthetic repair donor DNA oligonucleotide
tcacctccgtcaccgagttccagccgggcccctactgcgtcgtgctcctgtcctacgtcgtcgacgtccccgacggcaacaccgagga

SEQ ID NO: 411 - protein, 23 aa, Artificial Sequence
  synthetic peptide comprising linker and tobacco etch virus (TEV) protease cleavage site
GGGSQFGSGGGGGSGSENLYFQS

SEQ ID NO: 412 - DNA, 30 bp, Artificial Sequence
  synthetic maize ZmPYL-E mutant sequence
gcaccctggtgatcctgtcgttcgtggtcg

SEQ ID NO: 413 - DNA, 85 bp, Artificial Sequence
  synthetic termination sequence
gttttagagctagaaatagcaagttaaaataaggctagtccgttatcaacttgaaaaagtggcaccgagtcggtgcttttttttt

SEQ ID NO: 414 - DNA, 56 bp, Artificial Sequence
  synthetic maize ZmPYL-F wild-type sequence
gacggccgaccggggacgctcgtgatcgagtccttcgtggtggacgtccccgacgg

SEQ ID NO: 415 - DNA, 57 bp, Artificial Sequence
  synthetic maize ZmPYL-F sequence with targeted mutation 1a
gacggccgaccggggacgctcgtgatcgagtccttcgatggtggacgtccccgacgg

SEQ ID NO: 416 - DNA, 9 bp, Artificial Sequence
  synthetic maize ZmPYL-F sequence with targeted mutation 1b
ccccgacgg

SEQ ID NO: 417 - DNA, 53 bp, Artificial Sequence
  synthetic maize ZmPYL-F sequence with targeted mutation 2a
gacggccgaccggggacgctcgtgatcgagtccttggtggacgtccccgacgg

SEQ ID NO: 418 - DNA, 38 bp, Artificial Sequence
  synthetic maize ZmPYL-F sequence with targeted mutation 2b
gacggccgaccggggacgctcgtgatcgagcccgacgg

SEQ ID NO: 419 - DNA, 55 bp, Artificial Sequence
  synthetic maize ZmPYL-F sequence with targeted mutation 3a
gacggccgaccggggacgctcgtgatcgagtccttctggtggacgtccccgacgg

SEQ ID NO: 420 - DNA, 57 bp, Artificial Sequence
  synthetic maize ZmPYL-F sequence with targeted mutation 3b
gacggccgaccggggacgctcgtgatcgagtccttcggtggtggacgtccccgacgg

SEQ ID NO: 421 - DNA, 55 bp, Artificial Sequence
  synthetic maize ZmPYL-F sequence with targeted mutation 4a
gacggccgaccggggacgctcgtgatcgagtccttcgggtggacgtccccgacgg

SEQ ID NO: 422 - DNA, 57 bp, Artificial Sequence; identical to SEQ ID NO: 420
  synthetic maize ZmPYL-F sequence with targeted mutation 4b

SEQ ID NO: 423 - DNA, 63 bp, Artificial Sequence
  synthetic maize ZmPYL-F sequence with targeted mutation 5
gacggccgaccggggacgctcgtgatcgagtccttctcaagtgcaacctcaagtccccgacgg

SEQ ID NO: 424 - DNA, 41 bp, Artificial Sequence
  synthetic maize ZmPYL-F sequence with targeted mutation 6
gacggccgaccggggacgctcgtgatcgagtcccccgacgg

SEQ ID NO: 425 - DNA, 49 bp, Artificial Sequence
  synthetic maize ZmPYL-F sequence with targeted mutation 7a
gacggccgaccggggacgctcgtgatcgagtggtggacgtccccgacgg

SEQ ID NO: 426 - DNA, 55 bp, Artificial Sequence; identical to SEQ ID NO: 421
  synthetic maize ZmPYL-F sequence with targeted mutation 7b

SEQ ID NO: 427 - DNA, 57 bp, Artificial Sequence
  synthetic maize ZmPYL-F sequence with targeted mutation 8a
gacggccgaccggggacgctcgtgatcgagtccttcgttggtggacgtccccgacgg

SEQ ID NO: 428 - DNA, 46 bp, Artificial Sequence
  synthetic maize ZmPYL-F sequence with targeted mutation 8b
gacggccgaccggggacgctcgtgatcgagtggacgtccccgacgg

SEQ ID NO: 429 - DNA, 51 bp, Artificial Sequence
  synthetic maize ZmPYL-F sequence with targeted mutation 9a
gacggccgaccggggacgctcgtgatcgagtccttcgacgtccccgacggc

SEQ ID NO: 430 - DNA, 29 bp, Artificial Sequence
  synthetic maize ZmPYL-F sequence with targeted mutation 9b
gacggccgaccggggacgtccccgacggc

SEQ ID NO: 431 - DNA, 30 bp, Artificial Sequence
  synthetic gRNA target sequence
gctcgtgatcgagtccttcgtggtggacgt

SEQ ID NO: 432 - protein, 11 aa, Artificial Sequence
  Description of Artificial Sequence: Synthetic peptide
GILVIESYVVD

SEQ ID NO: 433 - DNA, 16 bp, Artificial Sequence
  Description of Artificial Sequence: Synthetic oligonucleotide
tcaagtgcaacctcaa

What is claimed is:

1. An isolated nucleic acid comprising a polypeptide encoding a mutated PYR/PYL receptor polypeptide comprising SEQ ID NO:216 or a mutated PYR/PYL receptor polypeptide having at least 95% sequence identity to SEQ ID NO:216 and wherein the position corresponding to L149 is L, wherein the mutated PYR/PYL receptor polypeptide has increased sensitivity to abscisic acid (ABA) compared to a control PYR/PYL receptor polypeptide comprising SEQ ID NO:216 wherein position 149 is E, not L, and wherein increased sensitivity is measured by determining the ability of the mutated PYR/PYL receptor polypeptide, expressed in yeast, to bind to and inactivate type 2 protein phosphatase (PP2C) in yeast to a greater extent than the control PYR/PYL receptor polypeptide expressed in yeast in the presence of the same concentration of ABA.

2. The isolated nucleic acid of claim 1, wherein the mutated PYR/PYL receptor polypeptide comprises SEQ ID NO: 390, 391, or 392.

3. The isolated nucleic acid of claim 1, wherein the polynucleotide encodes a fusion protein, the fusion protein comprising the mutated PYR/PYL receptor polypeptide and a fusion partner protein.

4. The isolated nucleic acid of claim 3, wherein the fusion partner protein is a transcriptional activation or modulation domain.

5. The isolated nucleic acid of claim 4, wherein the transcriptional activation domain is VP16 or VP64.

6. The isolated nucleic acid of claim 3, wherein the fusion protein further comprises a nuclear localization signal sequence.

7. A plant comprising the nucleic acid of claim 1.

8. The plant of claim 7, wherein the polynucleotide is an in situ mutated endogenous polynucleotide.

9. The isolated nucleic acid of claim 1, wherein the mutated PYR/PYL receptor polypeptide comprises SEQ ID NO:216.

* * * * *